US012760286B2

(12) United States Patent
Bryson et al.

(10) Patent No.: US 12,760,286 B2
(45) Date of Patent: Oct. 13, 2026

(54) METHODS OF EDITING NUCLEOTIDE POLYMORPHISM USING PROGRAMMABLE BASE EDITOR SYSTEMS

(71) Applicant: Beam Therapeutics Inc., Cambridge, MA (US)

(72) Inventors: David Bryson, Cambridge, MA (US); John Evans, Cambridge, MA (US); Michael Packer, Cambridge, MA (US); Jason Michael Gehrke, Cambridge, MA (US); Natalie Petrossian, Cambridge, MA (US)

(73) Assignee: Beam Therapeutics Inc., Cambridge, MA (US)

( * ) Notice: Subject to any disclaimer, the term of this patent is extended or adjusted under 35 U.S.C. 154(b) by 1437 days.

(21) Appl. No.: 17/054,324

(22) PCT Filed: May 11, 2019

(86) PCT No.: PCT/US2019/031899

§ 371 (c)(1),
(2) Date: Nov. 10, 2020

(87) PCT Pub. No.: WO2019/217944

PCT Pub. Date: Nov. 14, 2019

(65) Prior Publication Data

US 2021/0380955 A1 Dec. 9, 2021

Related U.S. Application Data

(60) Provisional application No. 62/817,986, filed on Mar. 13, 2019, provisional application No. 62/780,838, filed on Dec. 17, 2018, provisional application No. 62/670,588, filed on May 11, 2018.

(51) Int. Cl.

| | |
|---|---|
| ***C12N 9/22*** | (2006.01) |
| ***A61K 31/7088*** | (2006.01) |
| ***A61K 38/46*** | (2006.01) |
| ***A61K 38/50*** | (2006.01) |
| ***A61K 38/57*** | (2006.01) |
| ***A61K 48/00*** | (2006.01) |
| ***A61P 1/16*** | (2006.01) |
| ***A61P 3/00*** | (2006.01) |
| ***C12N 5/071*** | (2010.01) |
| ***C12N 5/0793*** | (2010.01) |
| ***C12N 9/78*** | (2006.01) |
| ***C12N 15/10*** | (2006.01) |
| ***C12N 15/11*** | (2006.01) |
| ***C12N 15/90*** | (2006.01) |

(52) U.S. Cl.

CPC ............ *C12N 9/22* (2013.01); *A61K 31/7088* (2013.01); *A61K 38/465* (2013.01); *A61K 38/50* (2013.01); *A61K 38/57* (2013.01); *A61K 48/0025* (2013.01); *A61P 1/16* (2018.01); *A61P 3/00* (2018.01); *C12N 5/0619* (2013.01); *C12N 5/067* (2013.01); *C12N 9/78* (2013.01); *C12N 15/102* (2013.01); *C12N 15/11* (2013.01); *C12N 15/907* (2013.01); *C12Y 305/04004* (2013.01); *C12N 2310/20* (2017.05); *C12N 2320/34* (2013.01); *C12N 2506/45* (2013.01); *C12N 2800/80* (2013.01)

(58) Field of Classification Search

None

See application file for complete search history.

(56) References Cited

U.S. PATENT DOCUMENTS

| | | | |
|---|---|---|---|
| 5,981,182 | A | 11/1999 | Jacobs, Jr. et al. |
| 6,479,299 | B1 | 11/2002 | Parce et al. |
| 6,586,192 | B1 | 7/2003 | Peschle et al. |
| 6,989,248 | B2 | 1/2006 | Longley |
| 7,101,710 | B2 | 9/2006 | Tsai et al. |
| 7,576,186 | B2 | 8/2009 | Lum et al. |
| 7,862,810 | B2 | 1/2011 | Anversa |
| 7,910,315 | B2 | 3/2011 | Modiano et al. |
| 7,915,114 | B2 | 3/2011 | Hsiao et al. |
| 8,518,716 | B2 | 8/2013 | Hubel et al. |
| 8,552,157 | B2 | 10/2013 | Amatulli et al. |
| 8,568,286 | B2 | 10/2013 | Sih et al. |
| 8,999,641 | B2 | 4/2015 | Zhang et al. |

(Continued)

FOREIGN PATENT DOCUMENTS

| | | |
|---|---|---|
| CN | 103088008 A | 5/2013 |
| CN | 104284669 A | 1/2015 |

(Continued)

OTHER PUBLICATIONS

Geng et al., "An insight into the protospacer adjacent motif of *Streptococcus pyogenes* Cas9 with artificially stimulated RNA-guided-Cas9 DNA cleavage flexibility" 6 RSC Advances 33514-33522 (Year: 2016).*

(Continued)

*Primary Examiner* — Nancy J Leith

(74) *Attorney, Agent, or Firm* — Greenberg Traurig, LLP; Melissa Hunter-Ensor; Nicholas R. Ballor

(57) ABSTRACT

The invention features compositions and methods for altering mutations associated with Rett Syndrome (RTT). Provided herein are compositions and methods of using base editors comprising a polynucleotide programmable nucleotide binding domain and a nucleobase editing domain in conjunction with a guide polynucleotide. Also provided herein are base editor systems for editing nucleobases of target nucleotide sequences.

10 Claims, 9 Drawing Sheets

Specification includes a Sequence Listing.

(56) References Cited

U.S. PATENT DOCUMENTS

| | | | |
|---|---|---|---|
| 9,068,179 | B1 | 6/2015 | Liu et al. |
| 9,322,037 | B2 | 4/2016 | Liu et al. |
| 9,388,430 | B2 | 7/2016 | Liu et al. |
| 9,512,446 | B1 | 12/2016 | Joung et al. |
| RE46,379 | E | 4/2017 | Chen-Kiang et al. |
| 9,737,604 | B2 | 8/2017 | Liu et al. |
| 9,816,998 | B2 | 11/2017 | Lyden et al. |
| 9,840,699 | B2 | 12/2017 | Liu et al. |
| 10,072,091 | B2 | 9/2018 | Weissman et al. |
| 10,111,966 | B2 | 10/2018 | Nixon et al. |
| 10,113,163 | B2 | 10/2018 | Liu et al. |
| 10,167,457 | B2 | 1/2019 | Liu et al. |
| 10,191,055 | B2 | 1/2019 | Vyas et al. |
| 10,465,176 | B2 | 11/2019 | Liu et al. |
| 10,466,244 | B2 | 11/2019 | Pillai et al. |
| 10,526,401 | B2 | 1/2020 | Muir et al. |
| 10,570,207 | B2 | 2/2020 | Scadden et al. |
| 10,624,973 | B2 | 4/2020 | Nixon et al. |
| 10,682,410 | B2 | 6/2020 | Liu et al. |
| 10,697,967 | B2 | 6/2020 | Liu et al. |
| 10,699,096 | B2 | 6/2020 | Yang |
| 10,745,677 | B2 | 8/2020 | Maianti et al. |
| 10,767,175 | B2 | 9/2020 | Dellinger et al. |
| 10,849,924 | B2 | 12/2020 | Goligorsky et al. |
| 10,874,710 | B2 | 12/2020 | Van Dongen et al. |
| 10,882,915 | B2 | 1/2021 | Pearse et al. |
| 10,899,843 | B2 | 1/2021 | Pearse et al. |
| 10,912,833 | B2 | 2/2021 | Liu et al. |
| 10,947,530 | B2 | 3/2021 | Liu et al. |
| 11,053,481 | B2 | 7/2021 | Liu et al. |
| 11,124,782 | B2 | 9/2021 | Liu et al. |
| 11,142,550 | B2 | 10/2021 | Muir et al. |
| 11,142,760 | B2 | 10/2021 | Slaymaker et al. |
| 11,155,803 | B2 | 10/2021 | Gaudelli et al. |
| 11,193,123 | B2 | 12/2021 | Halperin |
| 11,214,780 | B2 | 1/2022 | Liu et al. |
| 11,242,542 | B2 | 2/2022 | Vakulskas et al. |
| 11,268,082 | B2 | 3/2022 | Liu et al. |
| 11,306,324 | B2 | 4/2022 | Liu et al. |
| 11,319,532 | B2 | 5/2022 | Liu et al. |
| 11,344,609 | B2 | 5/2022 | Slaymaker et al. |
| 11,359,211 | B2 | 6/2022 | Church et al. |
| 11,473,108 | B2 | 10/2022 | Doudna et al. |
| 11,479,767 | B2 | 10/2022 | Smith et al. |
| 11,542,496 | B2 | 1/2023 | Liu et al. |
| 11,732,274 | B2 | 8/2023 | Liu et al. |
| 11,752,202 | B2 | 9/2023 | Slaymaker et al. |
| 11,795,443 | B2 | 10/2023 | Liu et al. |
| 11,866,727 | B2 | 1/2024 | Cowan et al. |
| 11,946,040 | B2 | 4/2024 | Joung et al. |
| 11,999,947 | B2 | 6/2024 | Liu et al. |
| 12,016,908 | B2 | 6/2024 | Slaymaker et al. |
| 12,129,478 | B1 | 10/2024 | Chen et al. |
| 12,133,884 | B2 | 11/2024 | Bryson et al. |
| 12,241,096 | B2 | 3/2025 | Joung et al. |
| 12,312,613 | B2 | 5/2025 | Kleinstiver et al. |
| 12,473,543 | B2 | 11/2025 | Liu et al. |
| 2003/0175973 | A1 | 9/2003 | Spence et al. |
| 2004/0003420 | A1 | 1/2004 | Kuhn et al. |
| 2004/0005623 | A1 | 1/2004 | Longley |
| 2004/0115184 | A1 | 6/2004 | Smith et al. |
| 2005/0003529 | A1 | 1/2005 | Taniguchi et al. |
| 2005/0032122 | A1 | 2/2005 | Hwang et al. |
| 2005/0124896 | A1 | 6/2005 | Richter et al. |
| 2005/0187607 | A1 | 8/2005 | Akhtar et al. |
| 2005/0222030 | A1 | 10/2005 | Allison |
| 2005/0260626 | A1 | 11/2005 | Lorens et al. |
| 2007/0071714 | A1 | 3/2007 | Zsebo et al. |
| 2007/0254319 | A1 | 11/2007 | Donnenberg et al. |
| 2008/0152652 | A1 | 6/2008 | Besmer et al. |
| 2008/0248503 | A1 | 10/2008 | Rich |
| 2009/0075381 | A1 | 3/2009 | Clarke et al. |
| 2009/0111119 | A1 | 4/2009 | Doyon et al. |
| 2009/0169613 | A1 | 7/2009 | Reznik et al. |
| 2010/0040587 | A1 | 2/2010 | Haag et al. |
| 2010/0226927 | A1 | 9/2010 | Weissman et al. |
| 2011/0009286 | A1 | 1/2011 | Andre et al. |
| 2011/0104787 | A1 | 5/2011 | Church et al. |
| 2011/0189211 | A1 | 8/2011 | Gentry et al. |
| 2011/0262465 | A1 | 10/2011 | Gao et al. |
| 2012/0264710 | A1 | 10/2012 | Sandvold et al. |
| 2013/0109048 | A1 | 5/2013 | Giugliano et al. |
| 2013/0252336 | A1 | 9/2013 | Coleman et al. |
| 2013/0260459 | A1 | 10/2013 | Coleman et al. |
| 2014/0068797 | A1 | 3/2014 | Doudna et al. |
| 2014/0186919 | A1 | 7/2014 | Zhang et al. |
| 2014/0186958 | A1 | 7/2014 | Zhang et al. |
| 2014/0273226 | A1 | 9/2014 | Wu |
| 2014/0273230 | A1 | 9/2014 | Chen et al. |
| 2014/0356956 | A1 | 12/2014 | Church et al. |
| 2015/0071899 | A1 | 3/2015 | Liu et al. |
| 2015/0071903 | A1 | 3/2015 | Liu et al. |
| 2015/0165054 | A1 | 6/2015 | Liu et al. |
| 2015/0166980 | A1 | 6/2015 | Liu et al. |
| 2015/0166982 | A1 | 6/2015 | Liu et al. |
| 2015/0166984 | A1 | 6/2015 | Liu et al. |
| 2015/0166985 | A1 | 6/2015 | Liu et al. |
| 2015/0224209 | A1 | 8/2015 | Kohn et al. |
| 2015/0241440 | A1 | 8/2015 | Fasan et al. |
| 2015/0344549 | A1 | 12/2015 | Muir et al. |
| 2016/0046961 | A1 | 2/2016 | Jinek et al. |
| 2016/0200779 | A1 | 7/2016 | Liu et al. |
| 2016/0201089 | A1 | 7/2016 | Gersbach et al. |
| 2016/0208243 | A1 | 7/2016 | Zhang et al. |
| 2016/0304846 | A1 | 10/2016 | Liu et al. |
| 2016/0324982 | A1 | 11/2016 | Scadden et al. |
| 2016/0355797 | A1 | 12/2016 | Konermann et al. |
| 2017/0066834 | A1 | 3/2017 | Weissman et al. |
| 2017/0121693 | A1 | 5/2017 | Liu et al. |
| 2017/0152528 | A1 | 6/2017 | Zhang |
| 2017/0233703 | A1 | 8/2017 | Xie et al. |
| 2017/0274100 | A1 | 9/2017 | Adair et al. |
| 2017/0275648 | A1 | 9/2017 | Barrangou et al. |
| 2017/0314015 | A1 | 11/2017 | Friedland et al. |
| 2017/0327804 | A9 | 11/2017 | Joung et al. |
| 2017/0360954 | A1 | 12/2017 | Nixon et al. |
| 2018/0002736 | A1 | 1/2018 | O'Connell et al. |
| 2018/0073012 | A1 | 3/2018 | Liu et al. |
| 2018/0127780 | A1 | 5/2018 | Liu et al. |
| 2018/0135109 | A1 | 5/2018 | Jayaram et al. |
| 2018/0155708 | A1 | 6/2018 | Church et al. |
| 2018/0170984 | A1 | 6/2018 | Harris et al. |
| 2018/0179503 | A1 | 6/2018 | Maianti et al. |
| 2018/0216095 | A1 | 8/2018 | Thanos et al. |
| 2018/0223313 | A1 | 8/2018 | Uchida et al. |
| 2018/0237768 | A1 | 8/2018 | Reik et al. |
| 2018/0237787 | A1 | 8/2018 | Maianti et al. |
| 2018/0289832 | A1 | 10/2018 | Hartigan et al. |
| 2018/0298421 | A1 | 10/2018 | Carpenter et al. |
| 2018/0312828 | A1 | 11/2018 | Liu et al. |
| 2018/0327507 | A1 | 11/2018 | Weissman et al. |
| 2019/0002875 | A1 | 1/2019 | Cheng et al. |
| 2019/0010471 | A1 | 1/2019 | Zhang et al. |
| 2019/0010481 | A1 | 1/2019 | Joung et al. |
| 2019/0093099 | A1 | 3/2019 | Liu et al. |
| 2019/0100593 | A1 | 4/2019 | Scadden et al. |
| 2019/0134217 | A1 | 5/2019 | Nixon et al. |
| 2019/0144558 | A1 | 5/2019 | Pearse et al. |
| 2019/0153114 | A1 | 5/2019 | Pearse et al. |
| 2019/0169639 | A1 | 6/2019 | Zhang et al. |
| 2019/0218547 | A1 | 7/2019 | Lee et al. |
| 2019/0225955 | A1 | 7/2019 | Liu et al. |
| 2019/0330373 | A1 | 10/2019 | Stephan |
| 2019/0330604 | A1 | 10/2019 | Lundberg et al. |
| 2019/0365806 | A1 | 12/2019 | Jeker et al. |
| 2019/0367891 | A1 | 12/2019 | Liu et al. |
| 2019/0382775 | A1 | 12/2019 | Tan et al. |
| 2020/0041513 | A1 | 2/2020 | Requirand et al. |
| 2020/0063127 | A1 | 2/2020 | Lu et al. |
| 2020/0129557 | A1 | 4/2020 | Shizuru et al. |
| 2020/0140818 | A1 | 5/2020 | Pompilio et al. |
| 2020/0188527 | A1 | 6/2020 | Rossi et al. |
| 2020/0190493 | A1 | 6/2020 | Liu et al. |
| 2020/0255523 | A1 | 8/2020 | Palchaudhuri et al. |

(56) References Cited

U.S. PATENT DOCUMENTS

| | | | |
|---|---|---|---|
| 2020/0308571 | A1 | 10/2020 | Joung et al. |
| 2020/0340985 | A1 | 10/2020 | Mikolajczyk et al. |
| 2020/0376135 | A1 | 12/2020 | Boitano et al. |
| 2020/0399619 | A1 | 12/2020 | Maianti et al. |
| 2020/0399626 | A1 | 12/2020 | Liu et al. |
| 2020/0407440 | A1 | 12/2020 | McDonagh et al. |
| 2021/0015917 | A1 | 1/2021 | Heiss et al. |
| 2021/0030851 | A1 | 2/2021 | Kong et al. |
| 2021/0032596 | A1 | 2/2021 | Heidaran et al. |
| 2021/0079344 | A1 | 3/2021 | Bosio et al. |
| 2021/0093667 | A1 | 4/2021 | Zhang et al. |
| 2021/0130800 | A1 | 5/2021 | Zhang et al. |
| 2021/0130805 | A1 | 5/2021 | Gaudelli et al. |
| 2021/0130850 | A1 | 5/2021 | Joung et al. |
| 2021/0137991 | A1 | 5/2021 | Rabinowitz |
| 2021/0162063 | A1 | 6/2021 | Nixon et al. |
| 2021/0171654 | A1 | 6/2021 | Liu et al. |
| 2021/0198330 | A1 | 7/2021 | Liu et al. |
| 2021/0206872 | A1 | 7/2021 | Pearse et al. |
| 2021/0252118 | A1 | 8/2021 | Slaymaker et al. |
| 2021/0261955 | A1 | 8/2021 | Slaymaker |
| 2021/0277379 | A1 | 9/2021 | Gaudelli et al. |
| 2021/0283267 | A1 | 9/2021 | Boitano et al. |
| 2021/0317228 | A1 | 10/2021 | Pearse et al. |
| 2021/0317440 | A1 | 10/2021 | Liu et al. |
| 2021/0371858 | A1 | 12/2021 | Evans et al. |
| 2021/0379195 | A1 | 12/2021 | Palchaudhuri et al. |
| 2021/0380955 | A1 | 12/2021 | Bryson et al. |
| 2021/0388094 | A1 | 12/2021 | Scadden et al. |
| 2021/0388396 | A1 | 12/2021 | Chen et al. |
| 2022/0023348 | A1 | 1/2022 | Gibbs et al. |
| 2022/0047637 | A1 | 2/2022 | Lamothe-Dreuzy et al. |
| 2022/0098572 | A1 | 3/2022 | Slaymaker et al. |
| 2022/0098593 | A1 | 3/2022 | Gaudelli et al. |
| 2022/0111079 | A1 | 4/2022 | Hoge et al. |
| 2022/0119785 | A1 | 4/2022 | Liu et al. |
| 2022/0127594 | A1 | 4/2022 | Gaudelli et al. |
| 2022/0133790 | A1 | 5/2022 | Gehrke et al. |
| 2022/0136012 | A1 | 5/2022 | Gaudelli et al. |
| 2022/0169998 | A1 | 6/2022 | Joung et al. |
| 2022/0170027 | A1 | 6/2022 | Gaudelli et al. |
| 2022/0220462 | A1 | 7/2022 | Liu et al. |
| 2022/0235347 | A1 | 7/2022 | Slaymaker et al. |
| 2022/0290115 | A1 | 9/2022 | Liu et al. |
| 2022/0290134 | A1 | 9/2022 | Jin et al. |
| 2022/0290164 | A1 | 9/2022 | Ran et al. |
| 2022/0307003 | A1 | 9/2022 | Liu et al. |
| 2022/0370575 | A1 | 11/2022 | Slaymaker et al. |
| 2022/0380757 | A1 | 12/2022 | Bauer et al. |
| 2022/0387622 | A1 | 12/2022 | Gehrke et al. |
| 2022/0401530 | A1 | 12/2022 | Bryson et al. |
| 2023/0017979 | A1 | 1/2023 | Hartigan et al. |
| 2023/0021641 | A1 | 1/2023 | Liu et al. |
| 2023/0075877 | A1 | 3/2023 | Gaudelli et al. |
| 2023/0080198 | A1 | 3/2023 | Gaudelli et al. |
| 2023/0101597 | A1 | 3/2023 | Gaudelli et al. |
| 2023/0108687 | A1 | 4/2023 | Liu et al. |
| 2023/0116627 | A1 | 4/2023 | Han |
| 2023/0127008 | A1 | 4/2023 | Liu |
| 2023/0128472 | A1 | 4/2023 | Slaymaker et al. |
| 2023/0140953 | A1 | 5/2023 | Slaymaker et al. |
| 2023/0159956 | A1 | 5/2023 | Bryson et al. |
| 2023/0193242 | A1 | 6/2023 | Zhang et al. |
| 2023/0212575 | A1 | 7/2023 | Odate et al. |
| 2023/0235309 | A1 | 7/2023 | Liu et al. |
| 2023/0242884 | A1 | 8/2023 | Smith et al. |
| 2023/0348883 | A1 | 11/2023 | Liu et al. |
| 2023/0383277 | A1 | 11/2023 | Cafferty et al. |
| 2023/0407277 | A1 | 12/2023 | Joung et al. |
| 2024/0124866 | A1 | 4/2024 | Liu et al. |
| 2024/0132867 | A1 | 4/2024 | Gaudelli et al. |
| 2024/0158775 | A1 | 5/2024 | Gaudelli et al. |
| 2024/0335516 | A1 | 10/2024 | Berkovitch et al. |
| 2025/0108098 | A1 | 4/2025 | Bryson et al. |
| 2025/0144149 | A1 | 5/2025 | Gaudelli et al. |

FOREIGN PATENT DOCUMENTS

| | | | |
|---|---|---|---|
| CN | 105793425 | A | 7/2016 |
| CN | 105934516 | A | 9/2016 |
| CN | 106011104 | A | 10/2016 |
| CN | 106061510 | A | 10/2016 |
| CN | 106916852 | A | 7/2017 |
| CN | 107043779 | A | 8/2017 |
| CN | 107109413 | A | 8/2017 |
| CN | 107532161 | A | 1/2018 |
| CN | 108064282 | A | 5/2018 |
| CN | 108290933 | A | 7/2018 |
| CN | 108291218 | A | 7/2018 |
| CN | 108513575 | A | 9/2018 |
| CN | 108699116 | A | 10/2018 |
| CN | 108823202 | A | 11/2018 |
| CN | 109295186 | A | 2/2019 |
| CN | 109306361 | A | 2/2019 |
| CN | 109328231 | A | 2/2019 |
| CN | 109385425 | A | 2/2019 |
| CN | 109957569 | A | 7/2019 |
| CN | 110042124 | A | 8/2019 |
| CN | 110157727 | A | 8/2019 |
| CN | 110214180 | A | 9/2019 |
| CN | 110835629 | A | 2/2020 |
| CN | 112175927 | A | 1/2021 |
| CN | 114040970 | A | 2/2022 |
| CN | 114045277 | A | 2/2022 |
| CN | 115427564 | B | 1/2025 |
| CN | 114144519 | B | 3/2025 |
| CN | 116135974 | B | 3/2025 |
| EP | 2574665 | A1 | 4/2013 |
| EP | 2707028 | B1 | 3/2017 |
| EP | 2877490 | B1 | 9/2018 |
| EP | 3700568 | A2 | 9/2020 |
| EP | 3877415 | A1 | 9/2021 |
| EP | 3886869 | A1 | 10/2021 |
| EP | 3956349 | A1 | 2/2022 |
| EP | 3958879 | A1 | 3/2022 |
| JP | 2015529466 | A | 10/2015 |
| JP | 2016528890 | A | 9/2016 |
| JP | 2017500035 | A | 1/2017 |
| JP | 2017527276 | A | 9/2017 |
| JP | 2018537963 | A | 12/2018 |
| JP | 6629734 | A2 | 1/2020 |
| JP | 7109784 | B2 | 8/2022 |
| JP | 7693552 | B2 | 6/2025 |
| KR | 20160050069 | A | 5/2016 |
| WO | 1992021766 | A1 | 12/1992 |
| WO | 1994008039 | A1 | 4/1994 |
| WO | 1996031538 | A1 | 10/1996 |
| WO | 1997025416 | A2 | 7/1997 |
| WO | 2000007021 | A1 | 2/2000 |
| WO | 2001038547 | A2 | 5/2001 |
| WO | 2002068676 | A2 | 9/2002 |
| WO | 2002103028 | A2 | 12/2002 |
| WO | 2003016867 | A2 | 2/2003 |
| WO | 2003026584 | A2 | 4/2003 |
| WO | 2003042405 | A2 | 5/2003 |
| WO | 2003065881 | A2 | 8/2003 |
| WO | 2004002425 | A2 | 1/2004 |
| WO | 2004005531 | A2 | 1/2004 |
| WO | 2005027972 | A2 | 3/2005 |
| WO | 2005042703 | A2 | 5/2005 |
| WO | 2006062946 | A2 | 6/2006 |
| WO | 2006074308 | A2 | 7/2006 |
| WO | 2007011088 | A1 | 1/2007 |
| WO | 2007048067 | A2 | 4/2007 |
| WO | 2007052849 | A1 | 5/2007 |
| WO | 2007084949 | A2 | 7/2007 |
| WO | 2007127317 | A2 | 11/2007 |
| WO | 2008067115 | A2 | 6/2008 |
| WO | 2008076143 | A1 | 6/2008 |
| WO | 2008085951 | A2 | 7/2008 |
| WO | 2008115300 | A1 | 9/2008 |
| WO | 2009058983 | A2 | 5/2009 |
| WO | 2010132092 | A2 | 11/2010 |
| WO | 2010136508 | A2 | 12/2010 |
| WO | 2010140885 | A1 | 12/2010 |

(56) References Cited

FOREIGN PATENT DOCUMENTS

| | | | |
|---|---|---|---|
| WO | 2011073521 | A1 | 6/2011 |
| WO | 2011075627 | A1 | 6/2011 |
| WO | 2012047951 | A2 | 4/2012 |
| WO | 2012154480 | A1 | 11/2012 |
| WO | 2012154962 | A2 | 11/2012 |
| WO | 2012171112 | A1 | 12/2012 |
| WO | 2013010406 | A1 | 1/2013 |
| WO | 2013045632 | A1 | 4/2013 |
| WO | 2013126794 | A1 | 8/2013 |
| WO | 2013165061 | A1 | 11/2013 |
| WO | 2013166281 | A1 | 11/2013 |
| WO | 2013176772 | A1 | 11/2013 |
| WO | 2013188037 | A2 | 12/2013 |
| WO | 2014004336 | A2 | 1/2014 |
| WO | 2014036219 | A2 | 3/2014 |
| WO | 2014043442 | A9 | 3/2014 |
| WO | 2014062978 | A1 | 4/2014 |
| WO | 2014066271 | A1 | 5/2014 |
| WO | 2014066545 | A1 | 5/2014 |
| WO | 2014081712 | A2 | 5/2014 |
| WO | 2014089290 | A1 | 6/2014 |
| WO | 2014184143 | A1 | 11/2014 |
| WO | 2014184741 | A1 | 11/2014 |
| WO | 2014186686 | A2 | 11/2014 |
| WO | 2014197748 | A2 | 12/2014 |
| WO | 2014197821 | A1 | 12/2014 |
| WO | 2014204728 | A1 | 12/2014 |
| WO | 2015004400 | A1 | 1/2015 |
| WO | 2015006294 | A2 | 1/2015 |
| WO | 2015006498 | A2 | 1/2015 |
| WO | 2015021426 | A1 | 2/2015 |
| WO | 2015089277 | A1 | 6/2015 |
| WO | 2015089406 | A1 | 6/2015 |
| WO | 2015089486 | A2 | 6/2015 |
| WO | 2015090230 | A1 | 6/2015 |
| WO | 2015092024 | A2 | 6/2015 |
| WO | 2015133554 | A1 | 9/2015 |
| WO | 2015142675 | A2 | 9/2015 |
| WO | 2015148512 | A1 | 10/2015 |
| WO | 2015153805 | A2 | 10/2015 |
| WO | 2015191693 | A2 | 12/2015 |
| WO | 2016011210 | A2 | 1/2016 |
| WO | 2016016343 | A1 | 2/2016 |
| WO | 2016016449 | A1 | 2/2016 |
| WO | 2016022363 | A2 | 2/2016 |
| WO | 2016038011 | A1 | 3/2016 |
| WO | 2016049258 | A2 | 3/2016 |
| WO | 2016061368 | A1 | 4/2016 |
| WO | 2016069910 | A1 | 5/2016 |
| WO | 2016072399 | A1 | 5/2016 |
| WO | 2016073433 | A1 | 5/2016 |
| WO | 2016073649 | A1 | 5/2016 |
| WO | 2016075612 | A1 | 5/2016 |
| WO | 2016094304 | A2 | 6/2016 |
| WO | 2016094872 | A1 | 6/2016 |
| WO | 2016112242 | A1 | 7/2016 |
| WO | 2016135558 | A2 | 9/2016 |
| WO | 2016135559 | A2 | 9/2016 |
| WO | 2016138038 | A1 | 9/2016 |
| WO | 2016142532 | A2 | 9/2016 |
| WO | 2016149682 | A2 | 9/2016 |
| WO | 2016164502 | A1 | 10/2016 |
| WO | 2016172727 | A1 | 10/2016 |
| WO | 2016183236 | A1 | 11/2016 |
| WO | 2016183438 | A1 | 11/2016 |
| WO | 2016196308 | A1 | 12/2016 |
| WO | 2016196388 | A1 | 12/2016 |
| WO | 2016196655 | A1 | 12/2016 |
| WO | 2016205711 | A1 | 12/2016 |
| WO | 2016205759 | A1 | 12/2016 |
| WO | 2017011721 | A1 | 1/2017 |
| WO | 2017048969 | A1 | 3/2017 |
| WO | 2017049166 | A1 | 3/2017 |
| WO | 2017070632 | A2 | 4/2017 |
| WO | 2017070633 | A2 | 4/2017 |
| WO | 2017077386 | A1 | 5/2017 |
| WO | 2017077394 | A2 | 5/2017 |
| WO | 2017079703 | A1 | 5/2017 |
| WO | 2017079705 | A1 | 5/2017 |
| WO | 2017093804 | A2 | 6/2017 |
| WO | 2017132580 | A2 | 8/2017 |
| WO | 2017152149 | A1 | 9/2017 |
| WO | 2017155937 | A1 | 9/2017 |
| WO | 2017160890 | A1 | 9/2017 |
| WO | 2017165862 | A1 | 9/2017 |
| WO | 2017173054 | A1 | 10/2017 |
| WO | 2017179718 | A1 | 10/2017 |
| WO | 2017180993 | A1 | 10/2017 |
| WO | 2017181110 | A1 | 10/2017 |
| WO | 2017184768 | A1 | 10/2017 |
| WO | 2017189308 | A1 | 11/2017 |
| WO | 2017191503 | A1 | 11/2017 |
| WO | 2017197238 | A1 | 11/2017 |
| WO | 2017205843 | A1 | 11/2017 |
| WO | 2017219029 | A2 | 12/2017 |
| WO | 2018009534 | A1 | 1/2018 |
| WO | 2018020323 | A2 | 2/2018 |
| WO | 2018027036 | A1 | 2/2018 |
| WO | 2018027078 | A1 | 2/2018 |
| WO | 2018035388 | A1 | 2/2018 |
| WO | 2018035503 | A1 | 2/2018 |
| WO | 2018039438 | A1 | 3/2018 |
| WO | 2018039810 | A1 | 3/2018 |
| WO | 2018041973 | A1 | 3/2018 |
| WO | 2018048815 | A1 | 3/2018 |
| WO | 2018071868 | A1 | 4/2018 |
| WO | 2018085516 | A2 | 5/2018 |
| WO | 2018085690 | A1 | 5/2018 |
| WO | 2018089664 | A1 | 5/2018 |
| WO | 2018119354 | A1 | 6/2018 |
| WO | 2018119359 | A1 | 6/2018 |
| WO | 2018129129 | A1 | 7/2018 |
| WO | 2018135860 | A1 | 7/2018 |
| WO | 2018140940 | A1 | 8/2018 |
| WO | 2018142364 | A1 | 8/2018 |
| WO | 2018160768 | A1 | 9/2018 |
| WO | 2018165629 | A1 | 9/2018 |
| WO | 2018170184 | A1 | 9/2018 |
| WO | 2018172794 | A1 | 9/2018 |
| WO | 2018176009 | A1 | 9/2018 |
| WO | 2018183613 | A1 | 10/2018 |
| WO | 2018191388 | A1 | 10/2018 |
| WO | 2018191746 | A1 | 10/2018 |
| WO | 2018213708 | A1 | 11/2018 |
| WO | 2018213726 | A1 | 11/2018 |
| WO | 2018218188 | A2 | 11/2018 |
| WO | 2019003193 | A1 | 1/2019 |
| WO | 2019005884 | A1 | 1/2019 |
| WO | 2019005886 | A1 | 1/2019 |
| WO | 2019018383 | A1 | 1/2019 |
| WO | 2019023680 | A1 | 1/2019 |
| WO | 2019040650 | A1 | 2/2019 |
| WO | 2019042284 | A1 | 3/2019 |
| WO | 2019071274 | A1 | 4/2019 |
| WO | 2019077496 | A1 | 4/2019 |
| WO | 2019079347 | A1 | 4/2019 |
| WO | 2019081982 | A1 | 5/2019 |
| WO | 2019082124 | A1 | 5/2019 |
| WO | 2019084053 | A1 | 5/2019 |
| WO | 2019084057 | A2 | 5/2019 |
| WO | 2019084062 | A1 | 5/2019 |
| WO | 2019084064 | A2 | 5/2019 |
| WO | 2019087047 | A1 | 5/2019 |
| WO | 2019111185 | A1 | 6/2019 |
| WO | 2019113437 | A1 | 6/2019 |
| WO | 2019118516 | A1 | 6/2019 |
| WO | 2019120310 | A1 | 6/2019 |
| WO | 2019126709 | A1 | 6/2019 |
| WO | 2019139645 | A2 | 7/2019 |
| WO | 2019155067 | A1 | 8/2019 |
| WO | 2019173654 | A2 | 9/2019 |
| WO | 2019178151 | A1 | 9/2019 |
| WO | 2019178280 | A1 | 9/2019 |
| WO | 2019178416 | A1 | 9/2019 |

(56) References Cited

FOREIGN PATENT DOCUMENTS

| | | | |
|---|---|---|---|
| WO | 2019178426 | A1 | 9/2019 |
| WO | 2019183000 | A1 | 9/2019 |
| WO | 2019191388 | A1 | 10/2019 |
| WO | 2019204378 | A1 | 10/2019 |
| WO | 2019217941 | A1 | 11/2019 |
| WO | 2019217942 | A1 | 11/2019 |
| WO | 2019217943 | A1 | 11/2019 |
| WO | 2019217944 | A1 | 11/2019 |
| WO | 2019222212 | A1 | 11/2019 |
| WO | 2019226953 | A1 | 11/2019 |
| WO | 2019234694 | A2 | 12/2019 |
| WO | 2020028823 | A1 | 2/2020 |
| WO | 2020041751 | A1 | 2/2020 |
| WO | 2020047326 | A2 | 3/2020 |
| WO | 2020051561 | A1 | 3/2020 |
| WO | 2020051562 | A2 | 3/2020 |
| WO | 2020065303 | A1 | 4/2020 |
| WO | 2020072534 | A1 | 4/2020 |
| WO | 2020076105 | A1 | 4/2020 |
| WO | 2020086776 | A1 | 4/2020 |
| WO | 2020092655 | A1 | 5/2020 |
| WO | 2020112687 | A2 | 6/2020 |
| WO | 2020112870 | A1 | 6/2020 |
| WO | 2020124008 | A1 | 6/2020 |
| WO | 2020160514 | A1 | 8/2020 |
| WO | 2020160517 | A1 | 8/2020 |
| WO | 2020163396 | A1 | 8/2020 |
| WO | 2020168051 | A1 | 8/2020 |
| WO | 2020168075 | A1 | 8/2020 |
| WO | 2020168088 | A1 | 8/2020 |
| WO | 2020168122 | A1 | 8/2020 |
| WO | 2020168132 | A1 | 8/2020 |
| WO | 2020168133 | A1 | 8/2020 |
| WO | 2020168135 | A1 | 8/2020 |
| WO | 2020214842 | A1 | 10/2020 |
| WO | 2020216947 | A1 | 10/2020 |
| WO | 2020219748 | A2 | 10/2020 |
| WO | 2020219770 | A1 | 10/2020 |
| WO | 2020219774 | A1 | 10/2020 |
| WO | 2020219775 | A1 | 10/2020 |
| WO | 2020219778 | A2 | 10/2020 |
| WO | 2020219861 | A1 | 10/2020 |
| WO | 2020219964 | A1 | 10/2020 |
| WO | 2020236936 | A1 | 11/2020 |
| WO | 2020236982 | A1 | 11/2020 |
| WO | 2020242895 | A1 | 12/2020 |
| WO | 2020248064 | A1 | 12/2020 |
| WO | 2021020884 | A2 | 2/2021 |
| WO | 2021022043 | A2 | 2/2021 |
| WO | 2021022044 | A1 | 2/2021 |
| WO | 2021041945 | A2 | 3/2021 |
| WO | 2021042062 | A2 | 3/2021 |
| WO | 2021044008 | A1 | 3/2021 |
| WO | 2021050571 | A1 | 3/2021 |
| WO | 2021052402 | A1 | 3/2021 |
| WO | 2021055408 | A1 | 3/2021 |
| WO | 2021055459 | A1 | 3/2021 |
| WO | 2021079273 | A1 | 4/2021 |
| WO | 2021081264 | A1 | 4/2021 |
| WO | 2021087182 | A1 | 5/2021 |
| WO | 2021091377 | A1 | 5/2021 |
| WO | 2021097329 | A1 | 5/2021 |
| WO | 2021099418 | A1 | 5/2021 |
| WO | 2021107566 | A1 | 6/2021 |
| WO | 2021108717 | A2 | 6/2021 |
| WO | 2021123397 | A1 | 6/2021 |
| WO | 2021158921 | A2 | 8/2021 |
| WO | 2021158995 | A1 | 8/2021 |
| WO | 2021158999 | A1 | 8/2021 |
| WO | 2021163587 | A1 | 8/2021 |
| WO | 2021175288 | A1 | 9/2021 |
| WO | 2021175914 | A1 | 9/2021 |
| WO | 2021188590 | A2 | 9/2021 |
| WO | 2021207651 | A2 | 10/2021 |
| WO | 2021211734 | A1 | 10/2021 |
| WO | 2021228944 | A1 | 11/2021 |
| WO | 2021239308 | A1 | 12/2021 |
| WO | 2021249228 | A1 | 12/2021 |
| WO | 2022008935 | A1 | 1/2022 |
| WO | 2022011458 | A1 | 1/2022 |
| WO | 2022015969 | A1 | 1/2022 |
| WO | 2022036179 | A2 | 2/2022 |
| WO | 2022040596 | A1 | 2/2022 |
| WO | 2022043538 | A1 | 3/2022 |
| WO | 2022056254 | A2 | 3/2022 |
| WO | 2022056324 | A1 | 3/2022 |
| WO | 2022081828 | A1 | 4/2022 |
| WO | 2022081890 | A1 | 4/2022 |
| WO | 2022112404 | A1 | 6/2022 |
| WO | 2022143694 | A1 | 7/2022 |
| WO | 2022148955 | A1 | 7/2022 |
| WO | 2022150367 | A1 | 7/2022 |
| WO | 2022150372 | A1 | 7/2022 |
| WO | 2022150706 | A2 | 7/2022 |
| WO | 2022155458 | A1 | 7/2022 |
| WO | 2022204574 | A1 | 9/2022 |
| WO | 2023004409 | A1 | 1/2023 |
| WO | 2023279118 | A2 | 1/2023 |
| WO | 2023288304 | A2 | 1/2023 |
| WO | 2023034959 | A2 | 3/2023 |
| WO | 2023047338 | A1 | 3/2023 |
| WO | 2023049299 | A2 | 3/2023 |
| WO | 2023064858 | A1 | 4/2023 |
| WO | 2023115012 | A2 | 6/2023 |
| WO | 2023118608 | A1 | 6/2023 |
| WO | 2023125814 | A1 | 7/2023 |
| WO | 2023155901 | A1 | 8/2023 |
| WO | 2023161873 | A1 | 8/2023 |
| WO | 2023193536 | A1 | 10/2023 |
| WO | 2023227669 | A3 | 11/2023 |
| WO | 2023247753 | A1 | 12/2023 |
| WO | 2023248110 | A1 | 12/2023 |
| WO | 2024006772 | A2 | 1/2024 |
| WO | 2024006774 | A2 | 1/2024 |
| WO | 2024040083 | A1 | 2/2024 |
| WO | 2024063273 | A1 | 3/2024 |
| WO | 2024073385 | A2 | 6/2024 |
| WO | 2024163862 | A2 | 8/2024 |
| WO | 2024179426 | A2 | 9/2024 |
| WO | 2024226156 | A1 | 10/2024 |
| WO | 2024227047 | A2 | 10/2024 |
| WO | 2024238562 | A2 | 11/2024 |
| WO | 2024259364 | A2 | 12/2024 |
| WO | 2025059520 | A1 | 3/2025 |

OTHER PUBLICATIONS

Kundu et al., "Leucine to proline substitution by SNP at position 197 in Caspase-9 gene expression leads to neuroblastoma: a bioinformatics analysis," 3 Biotech, 2013, vol. 3, pp. 225-234.

Lapinaite et al., "DNA capture by a CRISPR-Cas9-guided adenine base editor," Science, Jul. 31, 2020, vol. 369, No. 6503, pp. 566-571.

Lau et al., "Molecular basis for discriminating between normal and damaged bases by the human alkyladenine glycosylase, AAG," Proceedings of the National Academy of Sciences of the United States of America, Dec. 5, 2000, vol. 97, No. 25, pp. 13573-13578.

Lazar et al., "Transforming Growth Factor α: Mutation of Aspartic Acid 47 and Leucine 48 Results in Different Biological Activities," Molecular and Cellular Biology, Mar. 1988, vol. 8, No. 3, pp. 1247-1252.

Lee et al., "PIK3CA gene is frequently mutated in breast carcinomas and hepatocellular carcinomas," Oncogene, 2005, vol. 24, pp. 1477-1480.

Lenk et al., "Pathogenic Mechanism of the FIG4 Mutation Responsible for Charcot-Marie-Tooth Disease CMT4J," PLoS Genetics, Jun. 2011, vol. 7, No. 6, e1002104, pp. 1-13.

Li et al., "Current Approaches for Engineering Proteins with Diverse Biological Properties," Bio-Applications of Nanoparticles, 2007, pp. 1-16.

Liu et al., "C2c1-sgRNA Complex Structure Reveals RNA-Guided DNA Cleavage Mechanism," Molecular Cell, Jan. 19, 2017, vol. 65, pp. 310-322.

(56) References Cited

OTHER PUBLICATIONS

Lyons et al., "Efficient Recognition of an Unpaired Lesion by a DNA Repair Glycosylase," Journal of the American Chemical Society, 2009, vol. 131, No. 49, pp. 17742-17743.
Makarova et al., "Classification and Nomenclature of CRISPR-Cas Systems: Where from Here?," The CRISPR Journal, 2018, vol. 1, No. 5, pp. 325-336.
Mali et al., "Cas9 as a versatile tool for engineering biology," Nature Methods, Oct. 2013, vol. 10, No. 10, pp. 957-963.
Mali et al., "CAS9 transcriptional activators for target specificity screening and paired nickases for cooperative genome engineering," Nature Biotechnology, 2013, pp. 1-6.
Mccann et al., "MagnEdit—interacting factors that recruit DNA-editing enzymes to single base targets," Life Science Alliance, 2020, vol. 3, No. 4, e201900606, pp. 1-9.
Mikami et al., "Comparison of CRISPR/Cas9 expression constructs for efficient targeted mutagenesis in rice," Plant Molecular Biology, 2015, vol. 88, pp. 561-572.
Miller et al., "Continuous evolution of SpCas9 variants compatible with non-G PAMs," Nature Biotechnology, Apr. 2020, vol. 38, No. 4, pp. 471-481.
Mohamad et al., "Human hemoglobin G-Makassar variant masquerading as sickle cell anemia," Hematology Reports, 2018, vol. 10, No. 7210, pp. 92-95.
Mullins et al., "Transgenesis in Nonmurine Species," Hypertension, Oct. 1993, vol. 22, No. 4, pp. 630-633.
Navaratnam et al., "An Overview of Cytidine Deaminases," International Journal of Hematology, 2006, vol. 83, pp. 195-200.
Nishida et al., "Targeted nucleotide editing using hybrid prokaryotic and vertebrate adaptive immune systems," Science, Sep. 16, 2016, vol. 353, No. 6305, pp. 1248-aaf8729-8.
Nishimasu et al., "Engineered CRISPR-Cas9 nuclease with expanded targeting space," Science, Sep. 21, 2018, vol. 361, pp. 1259-1262.
Parr et al., "N1-Methylpseudouridine substitution enhances the performance of synthetic mRNA switches in cells," Nucleic Acids Research, 2020, vol. 48, No. 6, e35, pp. 1-9.
Pausch et al., "CRISPR-Casϕ from huge phages is a hypercompact genome editor," Science, Jul. 17, 2020, vol. 369, No. 6501, pp. 333-337.
Phillips, Anthony J., "The challenge of gene therapy and DNA delivery," Journal of Pharmacy and Pharmacology, 2001, vol. 53, pp. 1169-1174.
Poller et al., "A Leucine-to-Proline Substitution Causes a Defective α1-Antichymotrypsin Allele Associated with Familial Obstructive Lung Disease," Genomics, 1993, vol. 17, pp. 740-743.
Pournasr et al., "Modeling Inborn Errors of Hepatic Metabolism Using Induced Pluripotent Stem Cells," Arteriosclerosis, Thrombosis, and Vascular Biology, 2017, vol. 37, pp. 1994-1999.
Qi et al., "Repurposing CRISPR as an RNA-Guided Platform for Sequence-Specific Control of Gene Expression," Cell, Feb. 28, 2013, vol. 152, pp. 1173-1183.
Rees et al., "Analysis and minimization of cellular RNA editing by DNA adenine base editors," Science Advances, May 8, 2019, vol. 5, No. eaax5717, pp. 1-10.
Richter et al., "Phage-assisted evolution of an adenine base editor with improved Cas domain compatibility and activity," Nature Biotechnology, Jul. 2020, vol. 38, No. 7, pp. 883-891.
Sang, Helen, "Prospects for transgenesis in the chick," Mechanisms of Development, 2004, vol. 121, pp. 1179-1186.
Shmakov et al., "Discovery and Functional Characterization of Diverse Class 2 CRISPR-Cas Systems," Molecular Cell, Nov. 5, 2015, vol. 60, pp. 385-397.
Slaymaker et al., "Rationally engineered Cas9 nucleases with improved specificity," Science, Jan. 1, 2016, vol. 351, No. 6268, pp. 84-88.
Tan et al., "Engineering of high-precision base editors for site-specific single nucleotide replacement," Nature Communications, 2019, vol. 10, No. 439, pp. 1-10.
Tanenbaum et al., "A Protein-Tagging System for Signal Amplification in Gene Expression and Fluorescence Imaging," Cell, Oct. 23, 2014, vol. 159, pp. 635-646.
UniProt Accession No. P01011, Create Date Jul. 21, 1986.
UniProt Accession No. Q99ZW2, Create Date Jul. 11, 2012.
Wacey et al., "Disentangling the perturbational effects of amino acid substitutions in the DNA-binding domain of p53," Human Genetics, 1999, vol. 104, pp. 15-22.
Walton et al., "Unconstrained genome targeting with near-PAMless engineered CRISPR-Cas9 variants," Science, Mar. 26, 2020, pp. 1-11.
Wang et al., "Eliminating base-editor-induced genome-wide and transcriptome-wide off-target mutations," Nature Cell Biology, 2021, pp. 1-32.
Wolf et al., " tadA, an essential tRNA-specific adenosine deaminase from *Escherichia coli*," The EMBO Journal, 2002, vol. 21, No. 14, pp. 3841-3851.
Yan et al., "Functionally diverse type V CRISPR-Cas systems," Science, Jan. 4, 2019, vol. 363, pp. 88-91.
Yang et al., "Engineering and optimising deaminase fusions for genome editing," Nature Communications, 2016, vol. 7, No. 13330, pp. 1-11.
Yang et al., "PAM-Dependent Target DNA Recognition and Cleavage by C2c1 CRISPR-Cas Endonuclease," Cell, Dec. 15, 2016, vol. 167, pp. 1814-1828.
Yu et al., "Cytosine base editors with minimized unguided DNA and RNA off-target events and high on-target activity," Nature Communications, 2020, vol. 11, No. 2052, pp. 1-10.
Zafra et al., "Optimized base editors enable efficient editing in cells, organoids and mice," Nature Biotechnology, 2018, pp. 1-6.
Zheng et al., "DNA Editing in DNA/RNA Hybrids by Adenosine Deaminases That Act on RNA," Nucleic Acids Research, 2017, vol. 45, No. 6, pp. 3369-3377.
Zhou et al., "Atypical behaviour and connectivity in SHANK3-mutant macaques," Nature, Jun. 20, 2019, vol. 570, pp. 326-331.
Zuris et al., "Efficient Delivery of Genome-Editing Proteins In Vitro and In Vivo," Nature Biotechnology, Jan. 2015, vol. 33, No. 1, pp. 73-80.
Written Opinion dated Sep. 30, 2019 in corresponding International Patent Application No. PCT/US2019/031899 (7 pages).
Written Opinion dated Jun. 11, 2020 in corresponding International Patent Application No. PCT/US2020/018073 (19 pages).
Written Opinion dated Jun. 17, 2020 in corresponding International Patent Application No. PCT/US2020/018192 (6 pages).
Canver et al., "Customizing the genome as therapy for the β-hemoglobinopathies," Blood, May 26, 2016, vol. 127, No. 21, pp. 2536-2545.
Ekstrand et al., "Frequent alterations of the PI3K/AKT/mTOR pathways in hereditary nonpolyposis colorectal cancer," Familial Cancer, 2010, vol. 9, pp. 125-129.
Fitzhugh et al., "At least 20% donor myeloid chimerism is necessary to reverse the sickle phenotype after allogeneic HSCT," Blood, Oct. 26, 2017, vol. 130, No. 17, pp. 1946-1948.
Lavergne et al., "Defects in type IIA von Willebrand disease: a cysteine 509 to arginine substitution in the mature von Willebrand factor disrupts a disulphide loop involved in the interaction with platelet glycoprotein lb-IX," British Journal of Haematology, 1992, vol. 82, pp. 66-72.
Musallam et al., "Fetal hemoglobin levels and morbidity in untransfused patients with β-thalassemia intermedia," Blood, Jan. 12, 2012, vol. 119, No. 2, pp. 364-367.
Ngo et al., "Fetal haemoglobin levels and haematological characteristics of compound heterozygotes for haemoglobin S and deletional hereditary persistence of fetal haemoglobin," British Journal of Haematology, 2011, vol. 156, pp. 259-264.
UniProt Accession No. A0A5F1IHX6, downloaded Apr. 11, 2023.
UniProt Accession No. A8AD26, downloaded Apr. 11, 2023.
Wienert et al., "KLF1 drives the expression of fetal hemoglobin in British HPFH," Blood, Aug. 10, 2017, vol. 130, No. 6, pp. 803-807.
Yan et al., "High-efficiency and multiplex adenine base editing in plants using new TadA variants," Molecular Plant, May 3, 2021, vol. 14, pp. 722-731.

(56) References Cited

OTHER PUBLICATIONS

Shah et al., "Efficient and versatile CRISPR engineering of human neurons in culture to model neurological disorders," Version 1, Wellcome Open Research, Nov. 15, 2016, vol. 1, p. 13 (pp. 1-21).
Shah et al., "MeCP2 mutations: progress towards understanding and treating Rett syndrome," Genome Medicine, Feb. 17, 2017, vol. 9, p. 17 (pp. 1-4).
International Search Report and Written Opinion in corresponding International Patent Application No. PCT/US19/31899, mailed Sep. 30, 2019 (12 pages).
Alexandrov et al., "Signatures of mutational processes in human cancer," Nature, Aug. 22, 2013, vol. 500, pp. 415-421.
Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.
Azad et al., "Site-directed RNA editing by adenosine deaminase acting on RNA for correction of the genetic code in gene therapy," Gene Therapy, 2017, vol. 24, pp. 779-786.
Bae et al., "Cas-OFFinder: a fast and versatile algorithm that searches for potential off-target sites of Cas9 RNA-guided endonucleases," Bioinformatics, Jan. 24, 2014, vol. 30, No. 10, pp. 1473-1475.
Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079.
Branden and Tooze, "The Building Blocks," Introduction to Protein Structure, 1999, vol. 2, pp. 3-12.
Briner et al., "Guide RNA Functional Modules Direct Cas9 Activity and Orthogonality," Molecular Cell, Oct. 23, 2014, vol. 56, pp. 333-339.
Bulow et al., "Multienzyme systems obtained by gene fusion," Trends in Biotechnology, Jan. 1991, vol. 9, pp. 226-231.
Cameron, Ewan R., "Recent Advances in Transgenic Technology," Molecular Biotechnology, 1997, vol. 7, pp. 253-265.
Chatterjee et al., "A Cas9 with PAM recognition for adenine dinucleotides," Nature Communications, 2020, vol. 11, No. 2474, pp. 1-6.
Chichili et al., "Linkers in the structural biology of protein-protein interactions," Protein Science, 2013, vol. 22, pp. 153-167.
Chylinski et al., "The tracrRNA and Cas9 families of type II CRISPR-Cas immunity systems," RNA Biology, May 2013, vol. 10, No. 5, pp. 726-737.
Collantes et al., "Development and Characterization of a Modular CRISPR and RNA Aptamer Mediated Base Editing System," The CRISPR Journal, 2021, vol. 4, No. 1, pp. 58-68.
Cong et al., "Multiplex Genome Engineering Using CRISPR/Cas Systems," Science, Feb. 15, 2013, vol. 339, No. 6121, pp. 819-823.
Deltcheva et al., "CRISPR RNA maturation by trans-encoded small RNA and host factor RNase III," Nature, Mar. 31, 2011, vol. 471, pp. 602-607.
Endo et al., "Toward establishing an efficient and versatile gene targeting system in higher plants," Biocatalysis and Agricultural Biotechnology, 2014, vol. 3, pp. 2-6.
Ferretti et al., "Complete genome sequence of an M1 strain of *Streptococcus pyogenes*," Proceedings of the National Academy of Sciences of the United States of America, Apr. 10, 2001, vol. 98, No. 8, pp. 4658-4663.
Freshney et al., "Culture of Animal Cells, A Manual of Basic Technique," Food and Chemical Toxicology, 1983, vol. 23, No. 3, pp. 403-404.
Fu et al., "Human cell based directed evolution of adenine base editors with improved efficiency," Nature Communications, 2021, vol. 12, No. 5897, pp. 1-11.
Gardlik et al., "Vectors and delivery systems in gene therapy," Medical Science Monitor, 2005, vol. 11, No. 4, pp. RA110-RA121.
Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.
Gasiunas et al., "RNA-dependent DNA endonuclease Cas9 of the CRISPR system: Holy Grail of genome editing?" Trends in Microbiology, Nov. 2013, vol. 21, No. 11, pp. 562-567.
Gaudelli et al., "Directed evolution of adenine base editors with increased activity and therapeutic application," Nature Biotechnology, 2020, pp. 1-15.
Gaudelli et al., "Programmable base editing of A•T to G•C in genomic DNA without DNA cleavage," Nature, Nov. 23, 2017, vol. 551, pp. 464-471.
Grunewald et al., "CRISPR DNA base editors with reduced RNA off-target and self-editing activities," Nature Biotechnology, Sep. 2019, vol. 37, No. 9, pp. 1041-1048.
Guilinger et al., "Fusion of catalytically inactive Cas9 to FokI nuclease improves the specificity of genome modification," Nature Biotechnology, 2014, pp. 1-6.
Guo et al., "Protein tolerance to random amino acid change," Proceedings of the National Academy of Sciences of the United States of America, Jun. 22, 2004, vol. 101, No. 25, pp. 9205-9210.
Hess et al., "Methods and Applications of CRISPR-Mediated Base Editing in Eukaryotic Genomes," Molecular Cell, Oct. 5, 2017, vol. 68, pp. 26-43.
Hill et al., "Functional Analysis of Conserved Histidines in ADP-Glucose Pyrophosphorylase from *Escherichia coli*," Biochemical Biophysical Research Communications, 1998, vol. 244, No. 2, pp. 573-577.
Houdebine, Louis-Marie, "The methods to generate transgenic animals and to control transgene expression," Journal of Biotechnology, 2002, vol. 98, pp. 145-160.
Hu et al., "Evolved Cas9 variants with broad PAM compatibility and high DNA specificity," Nature, Apr. 5, 2018, vol. 556, pp. 57-63.
Huang et al., "DNA epigenome editing using CRISPR-Cas SunTag-directed DNMT3A," Genome Biology, 2017, vol. 18, No. 176, pp. 1-11.
Jeong et al., "Adenine base editor engineering reduces editing of bystander cytosines," Nature Biotechnology, 2021, pp. 1-12.
Jeong et al., "Precise adenine base editors that exhibit minimized cytosine catalysis," Research Square, 2020, pp. 1-15.
Jiang et al., "Chemical modifications of adenine base editor mRNA and guide RNA expand its application scope," Nature Communications, 2020, vol. 11, No. 1979, pp. 1-9.
Jinek et al., "A Programmable Dual-RNA-Guided DNA Endonuclease in Adaptive Bacterial Immunity," Science, Aug. 17, 2012, vol. 337, No. 6096, pp. 816-821.
Jinek et al., "RNA-programmed genome editing in human cells," eLife, 2013, vol. 2, No. e00471, pp. 1-9.
Jore et al., "Structural basis for CRISPR RNA-guided DNA recognition by Cascade," Nature Structural & Molecular Biology, May 2011, vol. 18, No. 5, pp. 529-537.
Kappel et al., "Regulating gene expression in transgenic animals," Current Opinion in Biotechnology, 1992, vol. 3, pp. 548-553.
Kim et al., "Adenine base editors catalyze cytosine conversions in human cells," Nature Biotechnology, Oct. 2019, vol. 37, pp. 1145-1148.
Kim et al., "Highly efficient RNA-guided genome editing in human cells via delivery of purified Cas9 ribonucleoproteins," Genome Research, 2014, vol. 24, pp. 1012-1019.
Kim et al., "Rescue of high-specificity Cas9 variants using sgRNAs with matched 5' nucleotides," Genome Biology, 2017, vol. 18, No. 218, pp. 1-6.
Kim et al., "Transcriptional Repression by Zinc Finger Peptides," The Journal of Biological Chemistry, Nov. 21, 1997, vol. 272, No. 47, pp. 29795-29800.
Kim et al., "Structural and Kinetic Characterization of *Escherichia Coli* TadA, the Wobble-Specific TRNA Deaminase," Biochemistry, 2006, vol. 45, No. 20, pp. 6407-6416.
Kleinstiver et al., "Broadening *Staphylococcus aureus* Cas9 Targeting Range by Modifying PAM Recognition," Nature Biotechnology, Dec. 2015, vol. 33, No. 12, pp. 1293-1298.
Kleinstiver et al., "Engineered CRISPR-Cas9 nucleases with altered PAM specificities," Nature, Jul. 23, 2015, vol. 523, pp. 481-485.

(56) References Cited

OTHER PUBLICATIONS

Kleinstiver et al., "High-fidelity CRISPR-Cas9 variants with undetectable genome-wide off-targets," Molecular Therapy, Jan. 28, 2016, vol. 529, No. 75187, pp. 490-495.
Koblan et al., "Improving cytidine and adenine base editors by expression optimization and ancestral reconstruction," Nature Biotechnology, 2018, pp. 1-4.
Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.
Komor et al., "Programmable editing of a target base in genomic DNA without double-stranded DNA cleavage," Nature, May 19, 2016, vol. 533, pp. 420-424.
Addgene Plasmid No. 44246, downloaded Aug. 23, 2023.
Addgene Plasmid No. 73021, downloaded Aug. 23, 2023.
Addgene Plasmid No. 79620, downloaded Aug. 23, 2023.
Aratyn-Schaus et al., "[589] Base-Editing as a Therapeutic Approach for the Direct Correction of Disease-Causing Mutations Underlying Glycogen Storage Disease Type IA," AASLD Abstracts (Poster), Hepatology, Oct. 2020, vol. 72, No. Suppl. 1, pp. 354A-355A.
Baligar et al., "Bone Marrow Stem Cell Therapy Partially Ameliorates Pathological Consequences in Livers of Mice Expressing Mutant Human a1-Antitrypsin," Hepatology, Apr. 2017, vol. 65, No. 4, pp. 1319-1335.
Bjursell et al., "Therapeutic Genome Editing With CRISPR/Cas9 in a Humanized Mouse Model Ameliorates α1-antitrypsin Deficiency Phenotype," EBioMedicine, 2018, vol. 29, pp. 104-111.
Burstein et al., "New CRISPR-Cas systems from uncultivated microbes," Nature, Feb. 9, 2017, vol. 542, Article No. 7640, pp. 237-241 and pp. 242-264 containing Methods, Extended Data, and Figures (28 total pages).
Chadwick et al., "In Vivo Base Editing of PCSK9 (Proprotein Convertase Subtilisin/Kexin Type 9) as a Therapeutic Alternative to Genome Editing," Arteriosclerosis, Thrombosis, and Vascular Biology, Sep. 2017, vol. 37, Article No. 9, pp. 1741-1747.
Cheng et al., "Cloning, expression and activity identification of human innate immune protein apolipoprotein B mRNA editing enzyme catalytic subunit 3A (APOBEC3A)," Chinese Journal of Cellular and Molecular Immunology, 2017, vol. 33, No. 2, pp. 179-184 [English Abstract].
Chester et al., "The apolipoprotein B mRNA editing complex performs a multifunctional cycle and suppresses nonsense-mediated decay," The EMBO Journal, 2003, vol. 22, No. 15, pp. 3971-3982.
Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.
GenBank Locus No. LC169509.1, downloaded Aug. 10, 2023.
GenBank NCBI Reference Sequence No. NM_000295.4, downloaded Aug. 23, 2023.
Greene et al., "Alpha-1 Antitrypsin Deficiency: Recent Developments in Gene Therapy Research," Gene Therapy Application, 2011, vol. 25, pp. 449-460.
Jha et al., "Single amino acid substitutions in recombinant plant-derived human α1-proteinase inhibitor confer enhanced stability and functional efficacy," Biochimica et Biophysica Acta, 2014, vol. 1840, pp. 416-427.
Kaya et al., "A bacterial Argonaute with noncanonical guide RNA specificity," Proceedings of the National Academy of Sciences of the United States of America, Apr. 12, 2016, vol. 113, No. 15, pp. 4057-4062.
Kim et al., "Increasing the genome-targeting scope and precision of base editing with engineered Cas9-cytidine deaminase fusions," Nature Biotechnology, Apr. 2017, vol. 35, Article No. 4, pp. 371-376 and pp. 377-385 containing Online Methods, Supplementary Material, Acknowledgments, References and Figures (15 total pages).
Kitamura et al., "Uracil DNA Glycosylase Counteracts APOBEC3G-Induced Hypermutation of Hepatitis B Viral Genomes: Excision Repair of Covalently Closed Circular DNA," PLoS Pathogens, May 2013, vol. 9, No. 5, e1003361, pp. 1-14.
Komor et al., "CRISPR-Based Technologies for the Manipulation of Eukaryotic Genomes," Cell, Jan. 12, 2017, vol. 168, pp. 20-36.
Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.
Ma et al., "Targeted AID-mediated mutagenesis (TAM) enables efficient genomic diversification in mammalian cells," Nature Methods, Dec. 2016, vol. 13, No. 12, pp. 1029-1035 and pp. 1036-1037 containing Online Methods (9 total pages).
Micozzi et al., "Human cytidine deaminase: A biochemical characterization of its naturally occurring variants," International Journal of Biological Macromolecules, Feb. 2014, vol. 63, pp. 64-74 and pp. 75-91 containing Acknowledgments, Abbreviations, References, and Figures (28 total pages).
NCBI Reference Sequence No. NP_000286.3, downloaded Sep. 27, 2023.
Okumura et al., "Evolutionary paths of streptococcal and staphylococcal superantigens," BMC Genomics, 2012, vol. 13, No. 404, pp. 1-16.
Plosky, Brian S., "CRISPR-Mediated Base Editing without DNA Double-Strand Breaks," Molecular Cell, May 19, 2016, vol. 62, pp. 477-478.
Putnam et al., "Protein Mimicry of DNA from Crystal Structures of the Uracil-DNA Glycosylase Inhibitor Protein and its Complex with *Escherichia coli* Uracil-DNA Glycosylase," Journal of Molecular Biology, 1999, vol. 287, pp. 331-346.
Qianqian, Xiong, "Advances in Diagnosis and Treatment of Glycogen Storage Diseases," Journal of Stroke and Neurological Diseases, 2017, vol. 34, No. 10, pp. 957-960 [English Abstract].
Qing et al., "Research progress on double-stranded RNA-specific adenosine deaminase—DSRAD/ADAR1," Foreign Medical Sciences, 2004, vol. 3, pp. 129-132 [English Abstract Only].
Rajamohan et al., "Current status of drug screening and disease modelling in human pluripotent stem cells," Bioessays, 2012, vol. 35, pp. 281-298.
Ramakrishna et al., "Gene disruption by cell-penetrating peptide-mediated delivery of Cas9 protein and guide RNA," Genome Research, 2014, vol. 24, pp. 1020-1027.
Ribeiro et al., "Protein Engineering Strategies to Expand CRISPR-Cas9 Applications," Hindawi: International Journal of Genomics, 2018, vol. 2018, No. 1652567, pp. 1-12.
Ryu et al., "Adenine base editing in mouse embryos and an adult mouse model of Duchenne muscular dystrophy," Nature Biotechnology, Jun. 2018, vol. 36, No. 6, pp. 536-539.
Sangkitporn et al., "Hb G Makassar (Beta 6: Glu→ Ala) in a Thai family," Journal of the Medical Association of Thailand, May 2002, vol. 85, No. 5, pp. 577-582.
Shen et al., "Amelioration of Alpha-1 Antitrypsin Deficiency Diseases with Genome Editing in Transgenic Mice," Human Gene Therapy, 2018, vol. 29, No. 8, pp. 861-873.
Shimomura et al., "Complete genome sequencing and analysis of a Lancefield group G *Streptococcus dysgalactiae* subsp. *equisimilis* strain causing streptococcal toxic shock syndrome (STSS)," BMC Genomics, 2011, vol. 12, No. 17, pp. 1-17.
Smith et al., "Efficient and Allele-Specific Genome Editing of Disease Loci in Human iPSCs," Molecular Therapy, Mar. 2015, vol. 23, No. 3, pp. 570-577.
Teng et al., "Mutational analysis of apolipoprotein B mRNA editing enzyme (APOBEC1): structure-function relationships of RNA editing and dimerization," Journal of Lipid Research, 1999, vol. 40, pp. 623-635.
UniProt Proteome ID No. UP000009215, downloaded Aug. 14, 2023.
Valdmanis et al., "Future of rAAV Gene Therapy: Platform for RNAi, Gene Editing, and Beyond," Human Gene Therapy, 2017, vol. 28, No. 4, pp. 361-372.
Wang et al., "Enhanced base editing by co-expression of free uracil DNA glycosylase inhibitor," Cell research, Oct. 2017, vol. 27, No. 10, pp. 1289-1292.

(56) References Cited

OTHER PUBLICATIONS

Werder et al., "Adenine base editing reduces misfolded protein accumulation and toxicity in alpha-1 antitrypsin deficient patient iPSC-hepatocytes," Molecular Therapy, Nov. 2021, vol. 29, No. 11, pp. 3219-3229.
Wijesinghe et al., "Efficient deamination of 5-methylcytosines in DNA by human APOBEC3A, but not by AID or APOBEC3G," Nucleic Acids Research, 2012, vol. 40, No. 18, pp. 9206-9217.
Yuliang et al., "Diagnosis and treatment of α1-antitrypsin deficiency," Practical Clinical Medicine, 2017, vol. 2, pp. 104-107 [English Abstract Only].
Zhang et al., "Progress in base editing technology based on CRISPR/Cas9 system and its application in medical research," Chinese Journal of Pharmacology and Toxicology, Jul. 2018, vol. 32, No. 7, pp. 507-514 [English Abstract].
Grunewald et al., "Transcriptome-wide off-target RNA editing induced by CRISPR-guided DNA base editors," Nature, May 2019, vol. 569, No. 7756, pp. 433-437.
Hua et al., "Expanding the base editing scope in rice by using Cas9 variants," Plant Biotechnology Journal, 2019, vol. 17, pp. 499-504.
Huang et al., "Circularly permuted and PAM-modified Cas9 variants broaden the targeting scope of base editors," Nature Biotechnology, Jun. 2019, vol. 37, No. 6, pp. 626-631.
Jin et al., "Cytosine, but not adenine, base editors induce genome-wide off-target mutations in rice," Science, Apr. 19, 2019, vol. 364, pp. 292-295.
Lee et al., "CRISPR-Pass: Gene Rescue of Nonsense Mutations Using Adenine Base Editors," Molecular Therapy, Aug. 2019, vol. 27, No. 8, pp. 1364-1371.
Lee et al., "Cytosine but not adenine base editor generates mutations in mice," bioRxiv, 2019, pp. 1-24.
Ran et al., "In vivo genome editing using *Staphylococcus aureus* Cas9," Nature, Apr. 9, 2015, vol. 520, No. 7546, pp. 186-191.
Rees et al., "Base editing: precision chemistry on the genome and transcriptome of living cells," Nature Reviews Genetics, Dec. 2018, vol. 19, No. 12, pp. 770-788.
Rees et al., "Improving the DNA specificity and applicability of base editing through protein engineering and protein delivery," Nature Communications, 2017, vol. 8, No. 15790, pp. 1-10.
Tsai et al., "GUIDE-seq enables genome-wide profiling of off-target cleavage by CRISPR-Cas nucleases," Nature Biotechnology, Feb. 2015, vol. 33, No. 2, pp. 187-197.
Yang et al., "Increasing targeting scope of adenosine base editors in mouse and rat embryos through fusion of TadA deaminase with Cas9 variants," Protein & Cell, 2018, vol. 9, No. 9, pp. 814-819.
Yeh et al., "In vivo base editing of post-mitotic sensory cells," Nature Communications, 2018, vol. 9, No. 2184, pp. 1-10.
Zhou et al., "Off-target RNA mutation induced by DNA base editing and its elimination by mutagenesis," Nature, Jul. 11, 2019, vol. 571, pp. 275-277.
Zuo et al., "Cytosine base editor generates substantial off-target singlenucleotide variants in mouse embryos," Science, vol. Apr. 19, 2019, vol. 364, No. 6437, pp. 289-292.
Extended European Search Report dated May 11, 2022 in European Patent Application No. 19799854.5 (13 pages).
Cartegni et al., "Determinants of Exon 7 Splicing in the Spinal Muscular Atrophy Genes, SMN1 and SMN2," The American Journal of Human Genetics, Jan. 2006, vol. 78, pp. 63-77.
Chang et al., "Degradation of survival motor neuron (SMN) protein is mediated via the ubiquitin/proteasome pathway," Neurochemistry International, 2004, vol. 45, pp. 1107-1112.
Charpentier et al. "Rewriting a genome", Nature, Mar. 2013, vol. 495, No. 7439, pp. 50-51.
Chen et al. "Targeting genomic rearrangements in tumor cells through Cas9-mediated insertion of a suicide gene." Nature Biotechnology, Jun. 2017, vol. 35, No. 6, pp. 543-552.
Cho et al., "A degron created by SMN2 exon 7 skipping is a principal contributor to spinal muscular atrophy severity," Genes & Development, 2010, vol. 24, pp. 438-442.
Corcia et al., "The importance of the SMN genes in the genetics of sporadic ALS," Amyotrophic Lateral Sclerosis, 2009, vol. 10, pp. 436-440.
Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).
Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.
De Souza. "Primer: genome editing with engineered nucleases." Nature Methods, vol. 9, No. 1, Jan. 2012, pp. 27-27.
D'Ydewalle et al., "The Antisense Transcript SMN-AS1 Regulates SMN Expression and Is a Novel Therapeutic Target for Spinal Muscular Atrophy," Neuron, Jan. 4, 2017, vol. 93, pp. 63-79.
GenBank Accession No. CTS26096.1, downloaded Apr. 9, 2024.
Geneseq, "*Streptococcus pyogenes* Cas9 protein", XP002808136, retrieved from EBI accession No. GSP: BIR16744 Database accession No. BIR16744 sequence—& DATBSE Geneseq [Online], Jan. 21, 2021.
Geneseq, "*Streptococcus pyogenes* Cas9 protein", XP002808135, retrieved from EBI accession No. GSP: BIR16747 Database accession No. BIR16747 sequence—& DATBSE Geneseq [Online], Jan. 21, 2021.
Geneseq, "Adenine deaminase polypeptide SEQ: 49.", XP002808137, retrieved from EBI accession No. GSP: BJG44493 Database accession No. BJG44493 sequence—& DATBSE Geneseq [Online], Jun. 10, 2021.
Grimm et al., "In vitro and In vivo Gene Therapy Vector Evolution via Multispecies Interbreeding and Retargeting of Adeno-Associated Viruses." J. Virol., 2008, vol. 82, pp. 5887-5911.
Guilinger et al. "Fusion of catalytically inactive Cas9 to Fokl nuclease improves the specificity of genome modification." Nature Biotechnology, 2014, vol. 32, pp. 577-582.
Jeong et al., "Measurement of deoxyinosine adduct: Can it be a reliable tool to assess oxidative or nitrosative DNA damage?," Toxicology Letters, 2012, vol. 214, pp. 226-233.
Le et al., "SMND7, the major product of the centromeric survival motor neuron (SMN2 ) gene, extends survival in mice with spinal muscular atrophy and associates with full-length SMN," Human Molecular Genetics, 2005, vol. 14, No. 6, pp. 845-857.
Lefebvre et al., "Identification and Characterization of a Spinal Muscular Atrophy-Determining Gene," Jan. 13, 1995, vol. 80, pp. 155-165.
Liu, et al. "Crossing the blood-brain barrier with AAV vectors," Metabolic Brain Disease, 2021, vol. 36, pp. 45-52.
Lorson et al., "A single nucleotide in the SMN gene regulates splicing and is responsible for spinal muscular atrophy," Proceedings of the National Academy of Sciences of the United States of America, May 1999, vol. 96, pp. 6307-6311.
Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.
Maeder et al. "CRISPR RNA-guided activation of endogenous human genes", Nature Methods, Oct. 2013, vol. 10, No. 10, pp. 977-979.
Monani et al., "A single nucleotide difference that alters splicing patterns distinguishes the SMA gene SMN1 from the copy gene SMN2," Human Molecular Genetics, 1999, vol. 8, No. 7, pp. 1177-1183.
Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.
NCBI Reference Sequence No. WP_032188360.1, downloaded Apr. 9, 2024.
Nelson et al., "In vivo genome editing improves muscle function in a mouse model of Duchenne muscular dystrophy," Science, Jan. 22, 2016, vol. 351, No., 6271, pp. 403-407.

(56) References Cited

OTHER PUBLICATIONS

Newby et al. "Base editing of haematopoietic stem cells rescues sickle cell disease in mice", Nature, Nature Publishing Group UK, London, 2021, vol. 595, Article No. 7866, pp. 295-302, p. 296; Figure 1, p. 301.
O'Connell et al., "Programmable RNA recognition and cleavage by CRISPR/Cas9." Nature, 2014, vol. 516, pp. 263-266.
Ousterout et al., "Multiplex CRISPR/Cas9-based genome editing for correction of dystrophin mutations that cause Duchenne muscular dystrophy," Nature Communications, vol. 6, No. 6244, pp. 1-13. 2015.
Pattanayak et al., "High-throughput profiling of off-target DNA cleavage reveals RNA-programmed Cas9 nuclease specificity," Nature Biotechnology, Sep. 2013, vol. 31, No. 9, pp. 839-843.
Ranzau et al., "The wild-type tRNA adenosine deaminase enzyme TadA is capable of sequence-specific DNA base editing." Chembiochem, Aug. 2023, vol. 24, No. 16, pp. 1-35.
Riesenberg et al. "Improved gRNA secondary structures allow editing of target sites resistant to CRISPR-Cas9 cleavage." Nature communications, 2022, vol. 13 No. 1, pp. 489.
Ruffolo, et al., "Design of highly functional genome editors by modeling of the universe of CRISPR-Cas Sequences," bioRxiv, posted Apr. 22, 2024, doi: 10.1101/2024.04.22.590591.
Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.
Singh et al., "Splicing of a Critical Exon of Human Survival Motor Neuron Is Regulated by a Unique Silencer Element Located in the Last Intron," Molecular and Cellular Biology, Feb. 2006, vol. 26, No. 4, pp. 1333-1346.
Song et al. "Delivery of CRISPR/Cas systems for cancer gene therapy and immunotherapy." Advanced Drug Delivery Reviews, 2021, vol. 168, pp. 150-180.
Stanton et al. "Systemic administration of novel engineered AAV capsids facilitates enhanced transgene expression in the macaque CNS." Med, 2023, vol. 4. No. 1, pp. 31-50.
Talbot et al., "Spinal muscular atrophy," Journal of Inherited Metabolic Disease, Jun. 2001, vol. 21, No. 2, pp. 189-197 [Abstract Only].
Thorpe et al. "Functional Correction of Episomal Mutations With Short Dna Fragments and RNA-DNA Oligonucleotides." Journal of Gene Medicine, Jan. 2002, vol. 4, No. 1, pp. 195-204.
Tipanee, et al. "Transposons: Moving Forward from Preclinical Studies to Clinical Trials," Human Gene Therapy, Nov. 2017, pp. 1087-1104.
Tsai et al. "Dimeric CRISPR RNA-guided FokI nucleases for highly specific genome editing." Nature Biotechnology, Apr. 2014, vol. 32, No. 6, pp. 569-576.
UniProt Accession No. Q6JC40, Downloaded Nov. 14, 2024.
Wan et al. "Material solutions for delivery of CRISPR/Cas-based genome editing tools: current status and future outlook." Materials Today, Jun. 2019, vol. 26, pp. 40-66.
Wirth et al., "Mildly affected patients with spinal muscular atrophy are partially protected by an increased SMN2 copy number," Human Genetics, 2006, vol. 119, pp. 422-428.
Zhou et al., "Cas 12a variants designed for lower genome-wide off-target effect through stringent PAM recognition", Molecular Therapy, Jan. 2022, vol. 30, No. 1 , pp. 1-12.
Written opinion dated Oct. 30, 2020 in corresponding International Patent Application No. PCT/US2020/033807 (12 pages).
Written Opinion dated Feb. 10, 2021 in corresponding International Patent Application No. PCT/US20/49975 (9 pages).
Partial European Search Report dated Feb. 9, 2022 in corresponding European Patent Application No. 19799854.5 (14 pages).
Casini et al., "A highly specific SpCas9 variant is identified by in vivo screening in yeast," Nature Biotechnology, Mar. 2018, vol. 36, No. 3, pp. 265-271 and pp. 15-20 containing Figures (20 total pages).
Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).
GenBank Accession No. AIT42264.1, downloaded Jan. 9, 2024.
GenBank Accession No. AKA60242.1, downloaded Jan. 9, 2024.
GenBank Accession No. AKQ21048.1, downloaded Jan. 9, 2024.
GenBank Accession No. AKS40380.1, downloaded Jan. 9, 2024.
GenBank Protein No. 4UN5_B, downloaded Jan. 9, 2024.
Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).
Kleinstiver et al., "Broadening the targeting range of *Staphylococcus aureus* CRISPR-Cas9 by modifying PAM recognition," Nature Biotechnology, Dec. 2015, vol. 33, No. 12, pp. 1293-1298 and p. 1299 containing Online Methods (7 total pages).
Lei et al., "Glucose-6-phosphatase dependent substrate transport in the glycogen storage disease type-1a mouse," Nature Genetics, Jun. 1996, vol. 13, pp. 203-209.
Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].
NCBI Reference Sequence No. NC_000001.11, downloaded Jan. 9, 2024.
NCBI Reference Sequence No. WP_002989955.1, downloaded Jan. 9, 2024.
NCBI Reference Sequence No. WP_010922251.1, downloaded Jan. 9, 2024.
NCBI Reference Sequence No. WP_011054416.1, downloaded Jan. 9, 2024.
NCBI Reference Sequence No. WP_011284745.1, downloaded Jan. 9, 2024.
NCBI Reference Sequence No. WP_011285506.1, downloaded Jan. 9, 2024.
NCBI Reference Sequence No. WP_011527619.1, downloaded Jan. 9, 2024.
NCBI Reference Sequence No. WP_012560673.1, downloaded Jan. 9, 2024.
NCBI Reference Sequence No. WP_014407541.1, downloaded Jan. 9, 2024.
NCBI Reference Sequence No. WP_020905136.1, downloaded Jan. 9, 2024.
NCBI Reference Sequence No. WP_023080005.1, downloaded Jan. 9, 2024.
NCBI Reference Sequence No. WP_023610282.1, downloaded Jan. 9, 2024.
NCBI Reference Sequence No. WP_030125963.1, downloaded Jan. 9, 2024.
NCBI Reference Sequence No. WP_030126706.1, downloaded Jan. 9, 2024.
NCBI Reference Sequence No. WP_031488318.1, downloaded Jan. 9, 2024.
NCBI Reference Sequence No. WP_032460140.1, downloaded Jan. 9, 2024.
NCBI Reference Sequence No. WP_032461047.1, downloaded Jan. 9, 2024.
NCBI Reference Sequence No. WP_032462016.1, downloaded Jan. 9, 2024.
NCBI Reference Sequence No. WP_032462936.1, downloaded Jan. 9, 2024.
NCBI Reference Sequence No. WP_032464890.1, downloaded Jan. 9, 2024.
NCBI Reference Sequence No. WP_038431314.1, downloaded Jan. 9, 2024.
NCBI Reference Sequence No. WP_038432938.1, downloaded Jan. 9, 2024.
NCBI Reference Sequence No. WP_038434062.1, downloaded Jan. 9, 2024.
NCBI Reference Sequence No. WP_048327215.1, downloaded Jan. 9, 2024.
NCBI Reference Sequence No. WP_049519324.1, downloaded Jan. 9, 2024.

(56) References Cited

OTHER PUBLICATIONS

NCBI Sequence No. WP_001297409.1, downloaded Aug. 14, 2023.
UniProt Accession No. P51908, Downloaded Jan. 9, 2024.
Wei et al., "The "new favorite" of gene editing technology-single base editors," Hereditas, 2017, vol. 39, No. 12, pp. 1115-1121 [English Abstract].
Sinnamon et al., "Site-directed RNA repair of endogenous Mecp2 RNA in neurons," Proceedings of the National Academy of Sciences of the United States of America, Oct. 16, 2017, pp. E9395-E9402.
Rahmig et al., "Improved human erythropoiesis and platelet formation in humanized NSGW41 mice," Stem Cell Reports, Oct. 11, 2016, vol. 7, pp. 591-601.
Rawat et al., "Peptide science at the Chemistry and Biology Interface," Curr. Protein Pept. Sci, 2017, vol. 18, No. 9 (1 page).
Rees et al., "Sickle-cell disease," The Lancet, Dec 11, 2010, vol. 376, pp. 2018-2031.
Rhoda et al., "Interaction of Hemoglobin Siriraj with Hemoglobin S: A Mild Sickle Cell Syndrome," Hemoglobin, 1986, vol. 10, No. 1, pp. 21-31.
Rieger and Schroeder, "Hematopoiesis," Cold Spring Harbor Perspectives in Biology, 2012, vol. 4, No. a008250, pp. 1-18.
Risueno et al., "Identification of T-lymphocytic leukemia-initiating stem cells residing in a small subset of patients with acute myeloid leukemic disease," Blood, Jun. 30, 2011, vol. 117, No. 26, pp. 7112-7120.
Rogozin et al. "Evolution and diversification of lamprey antigen receptors: evidence for involvement of an AID-Apobec family cytosine deaminase," Nature Immunology, Jun. 2007, vol. 8, No. 6, pp. 647-656.
Rozenski et al., "The RNA Modification Database: 1999 update," Nucleic Acids Research, 1999, vol. 27, No. 1, pp. 196-197.
Rubio et al., "An adenosine-to-inosine tRNA-editing enzyme that can perform C-to-U deamination of DNA," Proceedings of the National Academy of Sciences of the United States of America, May 8, 2007, vol. 104, No. 19, pp. 7821-7826.
Russell et al., "Plerixafor and granulocyte colony-stimulating factor for first-line steady-state autologous peripheral blood stem cell mobilization in lymphoma and multiple myeloma: results of the prospective PREDICT trial," Haematologica, 2013, vol. 98, No. 2, pp. 172-178.
Saechan et al., "Molecular basis and hematological features of hemoglobin variants in Southern Thailand," International Journal of Hematology, 2010, vol. 92, pp. 445-450.
Sakata et al., "Base editors for 1-6,9-26 simultaneous introduction of C-to-T and A-to-G mutations", Nature Biotechnology, Jun. 2020, vol. 38, No. 7, pp. 865-869.
Salinas. "Early T follicular helper cell activity accelerates hepatitis C virus-specific B cell expansion" Gen Bank. Web. Feb. 10, 2021; p. 1: from website: https://www.ncbi.nlm.nih.gov/protein/QRG33535.1.
Sang et al., "A unique uracil-DNA binding protein of the uracil DNA glycosylase superfamily," Nucleic Acids Research, Sep. 30, 2015, vol. 43, No. 17, pp. 8452-8463.
Sankaran et al., "Anemia: progress in molecular mechanisms and therapies," Nature Medicine, Mar. 2015, vol. 21, No. 3, pp. 221-230.
Saparbaev et al., "Excision of hypoxanthine from DNA containing dIMP residues by the Escherichia coli, yeast, rat, and human alkylpurine DNA glycosylases," Proceedings of the National Academy of Sciences of the United States of America, Jun. 1994, vol. 91, pp. 5873-5877.
Satomura et al., "Precise genome-wide base editing by the CRISPR Nickase system in yeast," Scientific Reports, 2017, vol. 7, No. 2095, pp. 1-10.
Saville et al., "Efficiencies of platform clinical trials: a vision for the future," Clinical Trials, 2016, vol. 13, No. 3, pp. 358-366.
Sawyer et al., "Ancient adaptive evolution of the primate antiviral DNA-editing enzyme APOBEC3G." PLoS Biol., Sep. 2004, vol. 2, No. 9 e275, pp. 1278-1285.
Scala et al., "Dynamics of genetically engineered hematopoietic stem and progenitor cells after autologous transplantation in humans," Nature Medicine, 2018, vol. 24, Article No. 11, pp. 1683-1690.
Schroeder et al., "Mobilization of allogeneic peripheral blood stem cell donors with intravenous plerixafor mobilizes a unique graft," Blood, May 11, 2017, vol. 129, No. 19, pp. 2680-2692.
Schwank et al., "Functional Repair of CFTR by CRISPR/Cas9 in Intestinal Stem Cell Organoids of Cystic Fibrosis Patients," Cell Stem Cell, Dec 2013, vol. 13, No. 6, pp. 653-658.
Schwartz et al., "A superactive insulin: [B10-Aspartic acid]insulin(human)," Proc. Natl. Acad. Sci. USA, Sep. 1987, vol. 84, pp. 6408-6411.
Shee et al., "Engineered proteins detect spontaneous DNA breakage in human and bacterial cells," eLife, 2013, vol. 2, No. e01222, pp. 1-25.
Shen et al., "Reconstruction of evolving gene variants and fitness from short sequencing reads," Nature Chemical Biology, Oct. 2021, vol. 17, No. 11, pp. 1188-1198.
Shi et al., "Structural basis for targeted DNA cytosine deamination and mutagenesis by APOBEC3A and APOBEC3B," Nature Structural & Molecular Biology, Feb. 2017, vol. 24, No. 2, pp. 131-139.
Shin et al., "High c-Kit expression identifies hematopoietic stem cells with impaired self-renewal and megakaryocytic bias," The Journal of Experimental Medicine, 2014, vol. 211, No. 2, pp. 217-231.
Simon et al., "KIT (CD117)—Positive Breast Cancers Are Infrequent and Lack KIT Gene Mutations," Clinical Cancer Research, Jan. 2004, vol. 10, pp. 178-183.
Skakic et al., "CRISPR/Cas9 genome editing of SLC37A4 gene elucidates the role of molecular markers of endoplasmic reticulum stress and apoptosis in renal involvement in glycogen storage disease type lb." Gene, Apr. 2019, vol. 703, pp. 17-25.
Skaldin et al. "Secreted Bacterial Adeonisine Deaminase is an Evolutionary Precursor of Adeonsine Deaminase Growth Factor," Moleculary Biology and Evolution, 2018, vol. 35, No. 12, pp. 2851-2861.
Stemcell Technologies, "Human Hematopoietic Stem and Progenitor Cell Phenotypes, Frequencies and Hierarchies," STEMCELL Technologies, 2016, Document No. 27034, Version 1.0.0, 1 page.
Stevens, "Design of a Split Intein with Exceptional Protein Splicing Activity," Journal of the ACS, Feb. 2016, vol. 138, pp. 2162-2165.
Strausberg. "Generation and initial analysis of more than 15,000 full-length human and mouse cDNA sequences" Gen Bank. Jul. 21, 2005; p. 1: from the web: https://www.ncbi.nlm.nih.gov/protein/AAH71593.1.
Strocchio et al., "Treosulfan-based conditioning regimen for allogeneic haematopoietic stem cell transplantation in children with sickle cell disease," British Journal of Haematology, 2015, vol. 169, pp. 726-736.
Sundd et al., "Pathophysiology of Sickle Cell Disease," Annual Review of Pathology: Mechanisms of Disease, 2019, vol. 14, pp. 263-292.
Tajer et al., "Ex Vivo Expansion of Hematopoietic Stem Cells for Therapeutic Purposes: Lessons from Development and the Niche," Cells, 2019, vol. 8, No. 169, pp. 1-15.
Tang et al., "Aptazyme-embedded guide RNAs enable ligand-responsive genome editing and transcriptional activation," Nature Communications, 2017, vol. 8, No. 15939, pp. 1-8.
Townsend et al., "Role of HFE in iron metabolism, hereditary haemochromatosis, anaemia of chronic disease, and secondary iron overload," The Lancet, Mar. 2, 2002, vol. 359, pp. 786-790.
Trakarnsanga et al., "An immortalized adult human erythroid line facilitates sustainable and scalable generation of functional red cells," Nature Communications, 2017, vol. 8, Article No. 14750, pp. 1-7.
Trakarnsanga et al., "Induction of adult levels of ß-globin in human erythroid cells that intrinsically express embryonic or fetal globin by transduction with KLF1 and BCL11A-XL," Haematologica, 2014, vol. 99, No. 11, pp. 1677-1685.
Traxler et al., "A genome-editing strategy to treat Beta-hemoglobinopathies that recapitulates a mutation associated with a benign genetic condition," Nature Medicine, Sep. 2016, vol. 22, No. 9, pp. 987-990, supplemental pp. 1-9.

(56) References Cited

OTHER PUBLICATIONS

Treisman et al., "Specific transcription and RNA splicing defects in five cloned B-thalassaemia genes," Nature, Apr. 14, 1983, vol. 302, pp. 591-596.
Truong et al., "Development of an intein-mediated split-Cas9 system for gene therapy," Nucleic Acids Research, Jul. 2015, vol. 43, No. 13, pp. 6450-6458 and Supplemental Information pp. 1-6 (15 p. total).
Tsai et al., "CIRCLE-seq: a highly sensitive in vitro screen for genome-wide CRISPR-Cas9 nuclease off-targets," Nature Methods, Jun. 2017, vol. 14, Article No. 6, pp. 607-614.
Uchida et al., "Serum-free Erythroid Differentiation for Efficient Genetic Modification and High-Level Adult Hemoglobin Production," Molecular Therapy: Methods & Clinical Development, Jun. 2018, vol. 9, pp. 247-256.
Uchida et al., "High-Efficiency Lentiviral Transduction of Human CD34+ Cells in High-Density Culture with Poloxamer and Prostaglandin E2," Molecular Therapy: Methods & Clinical Development, Jun. 2019, vol. 13, pp. 187-196.
UniProt Accession No. AH0355 (updated to QOWCY5 on Sep. 5, 2006).
Vakulskas et al., "A high-fidelity Cas9 mutant delivered as a ribonucleoprotein complex enables efficient gene editing in human hematopoietic stem and progenitor cells," Nature Medicine, Aug. 2018, vol. 24, Article No. 8, pp. 1216-1224.
Valdmanis et al., "A Mutation that Creates a Pseudoexon in SOD1 Causes Familial ALS," Annals of Human Genetics, 2009, vol. 73, pp. 652-657.
Vichinsky et al., "A Phase 3 Randomized Trial of Voxelotor in Sickle Cell Disease," The New England Journal of Medicine, Aug. 8, 2019, vol. 381, No. 6, pp. 509-519.
Vik et al., "Endonuclease V cleaves at inosines in RNA," Nature Communications, 2013, vol. 4, No. 2271, pp. 1-7.
Viprakasit et al., "Hb G-MAKASSAR [B6(A3)Glu->Ala; CODON 6 (Gag->Gcg)]: Molecular Characterization, Clinical, and Hematological Effects," Hemoglobin, 2002, vol. 26, No. 3, pp. 245-253.
Wang et al., "Hematopoietic Stem Cell Transplant into Non-Myeloablated W/Wv Mice to Detect Steady-State Engraftment Defects," Methods in Molecular Biology, 2008, vol. 430, pp. 171-181.
Wang et al., "BE-PIGS: a base-editing tool with deaminases inlaid into Cas9 PI domain significantly expanded the editing scope." Signal Transduction and Targeted Therapy, 2019, vol. 4, No. 36 (3 pages).
Weatherall, David J., "The Role of the Inherited Disorders of Hemoglobin, the First 'Molecular Diseases,' in the Future of Human Genetics," The Annual Review of Genomics and Human Genetics, 2013, vol. 14, pp. 1-24.
Wilburn et al., "The Prevalence and Role of Hemoglobin Variants in Biometric Screening of a Multiethnic Population: One Large Health System's Experience," American Journal of Clinical Pathology, 2017, vol. 147, pp. 589-595.
Wilkinson et al., "Long-term ex vivo haematopoietic-stem-cell expansion allows nonconditioned transplantation," Nature, Jul. 2019, vol. 571, Article No. 7763, pp. 117-121.
Winter et al., "Programmable Exon Skipping with Adenine Base Editors," Molecular Therapy, May 2018, vol. 26, No. 5S1, pp. 229-230.
Winter, et al. "Targeted exon skipping with AAV-mediated split adenine base editors," Cell Discovery, 2019, vol. 5, Article No. 1, pp. 1-12.
Wognum et al., "Mini-Review: Hematopoietic Stem and Progenitor Cells," STEMCELL Technologies, Apr. 2015, vol. 29068, No. 6.0.0, pp. 1-10.
Woodcock et al., "Master Protocols to Study Multiple Therapies, Multiple Diseases, or Both," The New England Journal of Medicine, Jul. 6, 2017, vol. 377, No. 1, pp. 62-70.
YAN. "Structural basis for bivalent binding and inhibition of SARS-CoV-2 infection by human potent neutralizing antibodies" GenBank. May 22, 2021: p. 1; from the website: https://www.ncbi.nlm.nih.gov/protein/7CZU_H.
Yang. "A missense mutation of KIT in hyperpigmentation and lentigines unassociated with systemic disorders: report of a Chinese pedigree" Gen Bank. May 20, 2022; p. 1: from the web: https://www.ncbi.nlm.nih.gov/protein/UQV80935. 1.
Yang et al., "APOBEC: From mutator to editor," Journal of Genetics and Genomics, 2017, vol. 44, pp. 423-437.
Yannaki et al., "Hematopoietic Stem Cell Mobilization for Gene Therapy of Adult Patients with Severe Beta-Thalassemia: Results of Clinical Trials Using G-CSF or Plerixafor in Splenectomized and Nonsplenectomized Subjects," Molecular Therapy, Jan. 2012, vol. 20, No. 1, pp. 230-238.
Yasui et al., "Miscoding Properties of 2'-Deoxyinosine, a Nitric Oxide-Derived DNA Adduct, during Translesion Synthesis Catalyzed by Human DNA Polymerases," Journal of Molecular Biology, 2008, vol. 377, pp. 1015-1023.
Yuan et al., "Genetic Modulation of RNA Splicing with a CRISPR-Guided Cytidine Deaminase," Molecular Cell, Oct. 18, 2018, vol. 72, pp. 380-394.
Yuzawa et al., "Structural basis for activation of the receptor tyrosine kinase KIT by stem cell factor." Cell, 2007, vol. 130, No. 2, pp. 323-334.
Zarrabi et al., "Manipulation of Hematopoietic Stem Cell Fate by Small Molecule Compounds," Stem Cells and Development, 2018, vol. 27, Article No. 17, pp. 1175-1190.
Zeng Jing et al.: "Therapeutic base editing of human hematopoietic stem cells", Nature Medicine, vol. 26, No. 4, Mar. 16, 2020, pp. 535-541.
Zhang et al., "Programmable base editing of zebrafish genome using a modified CRISPR-Cas9 system," Nature Communications, 2017, vol. 8, No. 118, pp. 1-5.
Zhang et al., "Myoediting: Toward Prevention of Muscular Dystrophy by Therapeutic Genome Editing," Physiological Reviews, 2018, vol. 98, Article No. 3, pp. 1205-1240.
Zhang et al., "Propagated perturbations from a peripheral mutation show interactions supporting WW domain thermostability," Structure, Nov. 2018, Vo. 26, pp. 1474-1485.
Zhou et al., "Seamless Genetic conversion of SMN2 to SMN1 via CRISPR/Cpf1 and Single-Stranded Oligodeoxynucleotides in Spinal Muscular Atrophy Patient-Specific Induced Pluripotent Stem Cells," Human Gene Therapy, 2018, vol. 29, Article No. 11, pp. 1252-1263.
Zonari et al., "Efficient Ex Vivo Engineering and Expansion of Highly Purified Human Hematopoietic Stem and Progenitor Cell Populations for Gene Therapy," Stem Cell Reports, Apr. 11, 2017, vol. 8, pp. 977-990.
Zong et al., "Precise base editing in rice, wheat and maize with a Cas9-cytidine deaminase fusion," Nature Biotechnology, 2017, pp. 1-4.
Xiao et al., "An adenine base editor variant expands context compatibility," Nature Biotechnology, Jan. 2024, vol. 42, pp. 1442-1453.
Liu et al., "Research Progress of Base Editing System," World Sci-Tech R&D, Dec 2017, vol. 39, No. 6, pp. 457-462 [English Abstract].
Liu et al., "Direct Promoter Repression by BCL11A Controls the Fetal to Adult Hemoglobin Switch," Cell, Apr. 19, 2018, vol. 173, pp. 1-13, e1-e8, supplemental pp. 1-9.
Losey et al., "Crystal structure of Staphylococcus aureus tRNA adenosine deaminase TadA in complex with RNA," Nature Structural & Molecular Biology, Feb. 2006, vol. 13, No. 2, pp. 153-159.
Lu et al., "Precise Editing of a Target Base in the Rice Genome Using a Modified CRISPR/Cas9 System," Molecular Plant, Mar. 2017, vol. 10, pp. 523-525,.
Lyst, et al., "Rett Syndrome Mutations Abolish the Interaction of MeCP2 with the NCoR/SMRT co-repressor," Nature Neuroscience, vol. 16, No. 7, Jun. 16, 2013 (Jun. 16, 2013), pp. 898-902.
Ma et al., "A new mutation in BFSP2 (G1091A) causes autosomal dominant congenital lamellar cataracts," Molecular Vision, Oct. 2008, vol. 14, pp. 1906-1911.

(56) References Cited

OTHER PUBLICATIONS

Maas et al., Identification and characterization of a human tRNA-specific adenosine deaminase related to the ADAR family of pre-mRNA editing enzymes, Proceedings of the National Academy of Sciences of the United States of America, Aug. 1999, vol. 96, pp. 8895-8900.
MacBeth et al., "Inositol Hexakisphosphate Is Bound in the ADAR2 Core and Required for RNA Editing," Science, Sep. 2, 2002, vol. 309, No. 5740, pp. 1534-1539.
Malashkevich et al., "Crystal structure of tRNA adenosine deaminase TadA from Escherichia coli," Worldwide Protein Data Bank, Mar. 10, 2005, vol. 1Z3A, pp. 1-13.
Mariani et al. "Species-specific exclusion of APOBEC3G from HIV-1 virions by Vif" Cell, 2003, vol. 114, No. 1, 21-31.
Martyn et al., "Natural regulatory mutations elevate the fetal globin gene via disruption of BCL11A or ZBTB7A binding," Nature Genetics, 2018, pp. 1-8.
Masuda et al., "Transcription factors LRF and BCL11A independently repress expression of fetal hemoglobin," Science, Jan. 15, 2016, vol. 351, Article No. 6270, pp. 285-289.
Matsoukas, Ianis G., "Commentary: Programmable base editing of A•T to G•C in genomic DNA without DNA cleavage," Frontiers in Genetics, Feb. 2018, vol. 9, No. 21, pp. 1-4.
Matthews et al., "Structures of human ADAR2 bound to dsRNA reveal base-flipping mechanism and basis for site selectivity," Nature Structural & Molecular Biology, May 2016, vol. 23, No. 5, pp. 426-433.
McDermott et al., "Comparison of human cord blood engraftment between immunocompromised mouse strains," Blood, Jul. 15, 2010, vol. 116, No. 2, pp. 193-200.
McIntosh et al., "Nonirradiated NOD, B6.SCID Il2ry-/- Kit(W41/W41) (NBSGW) mice support multilineage engraftment of human hematopoietic cells," Stem Cell Reports, Feb. 10, 2015, vol. 4, pp. 171-180.
Medyouf, Hind, "The microenvironment in human myeloid malignancies: emerging concepts and therapeutic Implications," Blood, Mar. 23, 2017, vol. 129, No. 12, pp. 1617-1626.
Meng et al., "Substitutions in the beta subunits of sickle-cell hemoglobin improve oxidative stability and increase the delay time of sickle-cell fiber formation," The Journal of Biological Chemistry, 2019, vol. 294, No. 11, pp. 4145-4159.
Miccio et al., "Novel genome-editing-based approaches to treat motor neuron diseases: Promises and challenges", Molecular Therapy, Jan. 2022, vol. 30, No. 1, pp. 47-53.
Miettinen et al., "Kit (CD117): a review on expression in normal and neoplastic tissues, and mutations and their clinicopathologic correlation." Applied immunohistochemistry & molecular morphology, 2005, vol. 13 No. 3, pp. 205-220.
Morrison et al., "A long noncoding RNA from the HBS1L-MYB intergenic region on chr6q23 regulates human fetal hemoglobin expression," Blood Cells, Molecules and Diseases, 2018, vol. 69, pp. 1-9.
Muller et al., "Nucleotide exchange and excision technology (Next) Dna shuffling: a robust method for DNA fragmentation and directed evolution," Nucleic Acids Research, 2005, vol. 33, No. 13, e117, pp. 1-9.
Myers et al., "Fine Structure Genetic Analysis of a B-Globin Promoter," Science, May 2, 1986, vol. 232, pp. 613-618.
NCBI Reference Protein No. Q694B3.2, downloaded Apr. 8, 2024.
NCBI GenPept. "C->U-Editing Enzyme APOBEC-1 Isoform X2 [Pan Troglodytes] NCBI Reference Sequence: Xp 024204018.1. "NCBI GenPept, Mar. 20, 2018, www.ncbi.nlm.nih.gov/protein/1367162674?sat=54&satkey=3052571. (Year: 2018).
Niihara et al., "A Phase 3 trial of L-glutamine in sickle cell disease," The New England Journal of Medicine, Jul. 19, 2018, vol. 379, No. 3, pp. 226-235.
Notta et al., "Engraftment of human hematopoietic stem cells is more efficient in female NOD/SCID/IL-2Rgc-null recipients," Blood, May 6, 2010, vol. 115, No. 18, pp. 3704-3707.
Notta et al., "Isolation of Single Human Hematopoietic Stem Cells Capable of Long-term Multilineage Engraftment," Science, Jul. 8, 2011, vol. 333, pp. 218-221.
Notta et al., "Distinct routes of lineage development reshape the human blood hierarchy across ontogeny," Science, Jan. 8, 2016, vol. 351, Article No. 6269, aab2116, pp. 1-22.
Nukiwa et al., "Identification of a second mutation in the protein-coding sequence of the Z type alpha 1-antitrypsin gene." J of Biol. Chem., Dec 5, 1986, vol. 261, No. 34, p. 15989-15994 (6 pages) and Additions and Corrections (1 page).
Nunez et al., "Chemical and Biophysical Modulation of Cas9 for Tunable Genome Engineering," ACS Chemical Biology, Feb. 2016, vol. 11, pp. 681-688.
Oakes et al., "Protein engineering of Cas9 for enhanced function", Jan. 2014, Methods in Enzymology, vol. 546, pp. 491-511.
Oakes et al., "CRISPR-Cas9 Circular Permutants as Programmable Scaffolds for Genome Modification," Cell, Jan. 10, 2019, vol. 176, pp. 254-267.
Pagnier et al., "Polymerization and solubility of recombinant hemoglobins alpha 2 beta 2 6 Glu->Ala (Hb Makassar) and alpha 2 beta 2 6 Glu->Ala, 23 Val->lle," Comptes Rendus de l Académie des Sciences—Series III—Sciences de la Vie, 1993, vol. 316, pp. 431-436.
Paikari and Sheehan, "Fetal haemoglobin induction in sickle cell disease." British Journal of Haematology, Jan. 2018, vol. 180, No. 2, pp. 189-200.
Palchaudhuri et at, "Non-genotoxic conditioning for hematopoietic stem cell transplantation using a hematopoietic-cell-specific internalizing immunotoxin," Nature Biotechnology, Jul. 2016, vol. 34, No. 7, pp. 738-745.
Pang et al., "Anti-CD117 antibody depletes normal and myelodysplastic syndrome human hematopoietic stem cells in xenografted mice," Blood, May 9, 2019, vol. 133, No. 19, pp. 2069-2078.
Panyasai et al., "Hemoglobin Variants in Northern Thailand: Prevalence, Heterogeneity and Molecular Characteristics," Genetic Testing and Molecular Biomarkers, 2016, vol. 20, No. 1, pp. 37-43.
Paquet et al., "Efficient introduction of specific homozygous and heterozygous mutations using CRISPR/Cas9," Nature, May 5, 2016, vol. 533, pp. 125-129.
Park et al., "A Comprehensive, Ethnically Diverse Library of Sickle Cell Disease-Specific Induced Pluripotent Stem Cells," Stem Cell Reports, Apr. 11, 2017, vol. 8, pp. 1076-1085.
Park et al., "Digenome-seq web tool for profiling CRISPR specificity," Nature Methods, Jun. 2017, vol. 14, No. 6, pp. 548-549.
Parkhill et al., "Genome sequence of Yersinia pestis, the causative agent of plague." Nature, Oct. 2001, vol. 413, No. 6855, pp. 523-527.
Pennuto et al., "From gene to therapy in spinal and bulbar muscular atrophy: Are we there yet?," Molecular and Cellular Endocrinology, 2018, vol. 465, pp. 113-121.
Piel et al., "Sickle Cell Disease," The New England Journal of Medicine, Apr. 20, 2017, vol. 376, No. 16, pp. 1561-1573.
Platt et al., "Mortality in Sickle Cell Disease: Life Expectancy and Risk Factors for Early Death," The New England Journal of Medicine, Jun. 9, 1994, vol. 330, No. 23, pp. 1639-1644.
Psatha et al., "Disruption of the BCL11A Erythroid Enhancer Reactivates Fetal Hemoglobin in Erythroid Cells of Patients with B-Thalassemia Major," Molecular Therapy: Methods & Clinical Development, Sep. 2018, vol. 10, pp. 313-326.
Psatha et al., "Brief Report: A Differential Transcriptomic Profile of Ex Vivo Expanded Adult Human Hematopoietic Stem Cells Empowers Them for Engraftment Better than Their Surface Phenotype," Stem Cells Translational Medicine, 2017, vol. 6, pp. 1852-1858.
Pule et al., "A Systematic Review of Known Mechanisms of Hydroxyurea-induced Foetal Haemoglobin for Treatment of Sickle Cell Disease," Expert Review of Hematology, Oct. 2015, vol. 8, Article No. 5, pp. 669-679.
Quintana et al., "Control of Treg and TH17 cell differentiation by the aryl hydrocarbon receptor," Nature, May 1, 2008, vol. 453, pp. 65-71.

(56) References Cited

OTHER PUBLICATIONS

Radtke et al., "A distinct hematopoietic stem cell population for rapid multilineage engraftment in nonhuman Primates," Science Translational Medicine, Nov. 1, 2017, vol. 9, No. eaan1145, pp. 1-10.
Adachi et al., "Effects of beta 6 amino acid hydrophobicity on stability and solubility of hemoglobin tetramers," FEBSLetters, Jan. 2, 1993, vol. 315, No. 1, pp. 47-50.
Adikusuma et al., "Versatile single-step-assembly CRISPR/Cas9 vectors for dual grna expression." PLOS One, Dec 2017, vol. 12, No. 12, pp. 1-11.
Agliano et al., "Human acute leukemia cells injected in NOD/LtSz-scid/IL-2Rgamma null mice generate a faster and more efficient disease compared to other NOD/scid-related strains." International Journal of Cancer, 2008, vol. 123, No. 9, pp. 2222-2227.
Agrawal et al., "Hydroxyurea in Sickle Cell Disease: Drug Review," Indian Journal of Hematology and Blood Transfusion, 2014, vol. 30, No. 2, pp. 91-96.
Akinsheye et al., "Fetal hemoglobin in sickle cell anemia," Blood, Jul. 7, 2011, vol. 118, No. 1, pp. 19-27.
Alexander et al., "HFE-associated hereditary hemochromatosis," Genetics in Medicine, May 2009, vol. 11, No. 5, pp. 307-313.
ALVAREZ. "In vivo mutagenesis of target DNA in E. coli chromosome with processive fusions of base deaminases and T7 Rna polymerase terminated by RNA-guided dCas9" Gen Bank. Web. Dec 7, 2019; p. 1, from the web: https://www.ncbi.nlm.nih.gov/protein/QGQ59661.1.
Alves et al., "Base editing as a genetic treatment for spinal muscular atrophy", bioRxiv, Jan. 21, 2023 (25 pages).
Anders, et al. "Structural Plasticity of PAM Recognition by Engineered Variants of the RNA-Guided Endonuclease Cas9." Mol Cell. Mar. 2016, vol. 61 No. 6, pp. 895-902.
Aratyn-Schaus et al., "in vivo base-editing corrects metabolic defects in glycogen storage disease type la", ESGCT Virtual Congress 2021, Oct. 20, 2021, pp. 1-13.
Arhab et al., "Base editing rescue of spinal muscular atrophy in cells and in mice", Science, Apr. 2023, vol. 380, No. 6642, pp. 1-28 and supplemental materials pp. 29-73.
Arnaoutova et al., "Base-editing corrects metabolic abnormalities in a humanized mouse model for glycogen storage disease type-la", Nature Communications, vol. 15, No. 1, Nov. 10, 2024, 1-18.
Ataga et al., "Crizanlizumab for the Prevention of Pain Crises in Sickle Cell Disease," The New England Journal of Medicine, Feb. 2, 2017, vol. 376, No. 5, pp. 429-439.
Badran et al., "Continuous evolution of Bacillus thuringiensis toxins overcomes insect resistance," Nature, May 5, 2016, vol. 533, No. 7601, p. 5863.
BAÑOS-SANZ et al., "Crystal structure and functional insights into uracil-DNA glycosylase inhibition by phage ¢29 DNA mimic protein p56," Nucleic Acids Research, 2013, vol. 41, No. 13, pp. 6761-6773.
Bartels et al. "Real time PCR detection of the PI*Z and PI*S mutations associated with alpha-1 antitrypsin deficiency." Am J Transl Res. Aug. 2009, vol. 1 No. 4, pp. 406-411.
Basila et al. "Minimal 2'-O-methyl Phosphorothioate Linkage Modification Pattern of Synthetic Guide RNAs for Increased Stability and Efficient CRISPR-Cas9 Gene Editing Avoiding Cellular Toxicity," PLOS One, 2017 (19 pages).
Baudin-Chich et al., "Enhanced Polymerization of Recombinant Human Deoxyhemoglobin ß6 Glu—>IIe," Proceedings of the National Academy of Sciences of the Untied States of America, Mar. 1990, vol. 87, pp. 1845-1849.
Bergman et al., "A New Beta-Chain Variant: Hb Stockholm [Beta 7(A4)Glu -Asp] Causes Falsely Low Hb A1c," Hemoglobin, 2009, vol. 33, No. 2, pp. 137-142.
Bernaudin et al., "Long-term results of related myeloablative stem-cell transplantation to cure sickle cell disease," Blood, Oct. 1, 2007, vol. 110, No. 7, pp. 2749-2756.
Biasco et al., "In Vivo Tracking of Human Hematopoiesis Reveals Patterns of Clonal Dynamics during Early and Steady-State Reconstitution Phases," Cell Stem Cell, Jul. 7, 2016, vol. 19, pp. 107-119.
Bihoreau et al., "Steric and hydrophobic determinants of the solubilities of recombinant sickle cell hemoglobins," Protein Science, 1992, vol. 1, pp. 145-150.
Bird et al., "Expansion of Human and Murine Hematopoietic Stem and Progenitor Cells Ex Vivo without Genetic Modification Using MYC and Bcl-2 Fusion Proteins," PLoS One, Aug. 2014, vol. 9, No. 8, e105525, pp. 1-20.
Blackwell et al., "Hemoglobin G Makassar: ß-6 Glu—>Ala," Biochimica et Biophysica Acta, 1970, vol. 214, pp. 396-401.
Blackwell et al., "Haemoglobin Siriraj, β-7 (BA4) Glu—>Lys, in a Chinese Subject in Taiwan," Vox Sanguinis, 1972, vol. 23, pp. 433-438.
Borel et al., "Survival Advantage of Both Human Hepatocyte Xenografts and Genome-Edited Hepatocytes for Treatment of a-1 Antitrypsin Deficiency." Molecular Therapy, Nov. 2017, vol. 25, No. 11, pp. 2477-2489 and pp. 1-3 supplemental info (16 p. total).
Borsotti et al., "HSC extrinsic sex-related and intrinsic autoimmune disease-related human B-cell variation is recapitulated in humanized mice," Blood Advances, Oct. 24, 2017, vol. 1, No. 23, pp. 2007-2018.
Boulad et al., "Safety and efficacy of plerixafor dose escalation for the mobilization of CD34+ hematopoietic progenitor cells in patients with sickle cell disease: interim results," Haematologica, 2018, vol. 103, No. 5, pp. 770-777.
Bradford et al., "Quiescence, cycling, and turnover in the primitive hematopoietic stem cell compartment," Experimental Hematology, 1997, vol. 25, pp. 445-453.
Brooks et al. "A base editing strategy using mRNA-LNPs for in vivo correction of the most frequent phenylketonuria variant," Human Genetics and Genomics Advances, Jan. 11, 2024, vol. 5, 100253, pp. 1-6 [retrieved on 21.10.2025].
Burgess et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," The Journal of Cell Biology, Nov. 1990, vol. 111, pp. 2129-2138.
Burroughs et al., "Allogeneic Hematopoietic Cell Transplantation Using Treosulfan-Based Conditioning for Treatment of Marrow Failure Disorders," Biology of Blood and Marrow Transplantation, 2017, vol. 23, pp. 1669-1677.
Cai et al., "A Universal Approach to Correct Various HBB Gene Mutations in Human Stem Cells for Gene Therapy of Beta-Thalassemia and Sickle Cell Disease," Stem Cells Translational Medicine, 2018, vol. 7, pp. 87-97.
Canver et al., "Integrated design, execution, and analysis of arrayed and pooled CRISPR genome-editing experiments," Nature Protocols, 2018, vol. 13, No. 5, pp. 946-986.
Chang et al., "Long-Term Engraftment and Fetal Globin Induction upon BCL11A Gene Editing in Bone-Marrow-Derived CD34+ Hematopoietic Stem and Progenitor Cells," Molecular Therapy: Methods & Clinical Development, Mar. 2017, vol. 4, pp. 137-148.
Chang et al., "Comparative Studies Reveal Robust HbF Induction By Editing of HBG1/2 Promoters or BCL11A Erythroid-Enhancer in Human CD34+ Cells but That BCL11A Erythroid-Enhancer Editing Is Associated with Selective Reduction in Erythroid Lineage Reconstitution in a Xenotransplantation Model," Blood, Nov. 29, 2018, vol. 132, Article No. Suppl. 1, p. 409.
Chang et al., "Saturated Mutagenesis Surrounding Beta-globin Locus Identifies Novel Therapeutic Targets for Fetal Globin Induction and Treatment of Sickle Cell Anemia," Editas Medicine, PowerPoint Presentation, 2018, p. 196.
Chatterjee et al. "Minimal PAM specificity of a highly similar SpCas9 ortholog." Science Advances, 2018, vol. 4, No. 10, pp. 1-10.
Chaudhari et al., "Evaluation of Homology-Independent CRISPR-Cas9 Off-Target Assessment Methods," The CRISPR Journal, 2020, vol. 3, No. 6, pp. 440-453.
Cheng et al. "Production of High-Affinity Human Monoclonal Antibody Fab Fragments to the 19-Kilodalton C-Terminal Merozoite

(56) References Cited

OTHER PUBLICATIONS

Surface Protein 1 of Plasmodium falciparum" GenBank. Jul. 23, 2016; p. 1: from the web: https://www.ncbi.nlm.nih.gov/protein/BAF64543.1.
Cheng et al., "Plerixafor is effective given either preemptively or as a rescue strategy in poor stem cell mobilizing patients with multiple myeloma," Transfusion, Feb. 2015, vol. 55, pp. 275-283.
Cheriyan et al., "Faster Protein Splicing with the Nostoc punctiforme DnaE Intein Using Non-native Extein Residues," Journal of Biological Chemistry, Mar. 2013, vol. 288, No. 9, pp. 6202-6211.
Chew et al., "A multifunctional AAV-CRISPR-Cas9 and its host response," Nature Methods, Sep. 2016, vol. 13, No. 10, pp. 868-874, Online Methods pp. 1-5, and Supplemental Information pp. 1-33 (45 pages total).
Chhabra et al., "Hematopoietic stem cell transplantation in immunocompetent hosts without radiation or chemotherapy," Science Translational Medicine, Aug. 10, 2016, vol. 8, No. 351, 351ra105, pp. 1-28.
Choi et al., "No. evidence for cell activation or brain vaso-occlusion with plerixafor mobilization in sickle cell mice," Blood Cells, Molecules, and Diseases, Mar. 2016, vol. 57, pp. 67-70.
Chou et al., "Mutations in the Glucose-6-Phosphatase-a (G6PC) Gene That Cause Type la Glycogen Storage Disease." Human Mutation, 2008, vol. 29 No. 7, pp. 921-930.
Chu et al. "Rationally Designed Base Editors for Precise Editing of the Sickle Cell Disease Mutation." The CRISPR Journal, Apr. 2021, vol. 4, No. 2, pp. 169-177.
Cofsky et al., "CRISPR-Cas9 bends and twists DNA to read its sequence, " Nat Struct Mol Biol, Apr. 2022, vol. 29, No. 4, pp. 395-402.
Conticello, "The AID/APOBEC family of nucleic acid mutators." Genome Biology, 2008, vol. 9, No. 229 (10 pages).
Corrado et al., "SOD1 gene mutations in Italian patients with Sporadic Amyotrophic Lateral Sclerosis (ALS)," Neuromuscular Disorders, 2006, vol. 16, pp. 800-804.
Huang et al., "Comparative analysis of three-dimensional chromosomal architecture identifies a novel fetal hemoglobin regulatory element," Genes & Development, 2017, vol. 31, pp. 1704-1713.
Huang et al., "Neutralizing negative epigenetic regulation by HDAC5 enhances human haematopoietic stem cell homing and engraftment," Nature Communications, 2018, vol. 9, No. 2741, pp. 1-13.
Husa et al., "Generation of CD34 Fluorescent Reporter Human Induced Pluripotent Stem Cells for Monitoring Hematopoietic Differentiation," Stem Cells and Development, 2018, pp. 1-34.
Iida, Madoka, "[HT-10-1] Molecular mechanisms of neuromuscular degeneration in spinal and bulbar muscular atrophy," 60th Annual Meeting of the Japanese Society of Neurology, May 25, 2019, vol. 69, No. S51, p. 1 [English Abstract Only].
Johnson et al., Mutational Analysis of CD45. J. Biol. Chem. Vol 267, No 12, Issue of Apr. 25, 1992, vol. 267, No. 12, pp. 8035-8041. Abstract.
Kariko et al., "Suppression of RNA Recognition by Toll-like Receptors: The Impact of Nucleoside Modification and the Evolutionary Origin of RNA," Immunity, Aug. 2005, vol. 23, pp. 165-175.
Karponi et al., "Plerixafor+G-CSF-mobilized CD34+ cells represent an optimal graft source for thalassemia gene therapy," Blood, Jul. 30, 2015, vol. 126, No. 5, pp. 616-619.
Karpova et al., "Continuous blockade of CXCR4 results in dramatic mobilization and expansion of hematopoietic stem and progenitor cells," Blood, May 25, 2017, vol. 129, No. 21, pp. 2939-2949.
Karpova et al., "Mobilization of hematopoietic stem cells with the novel CXCR4 antagonist POL6326 (balixafortide) in healthy volunteers - results of a dose escalation trial," Journal of Translational Medicine, 2017, vol. 15, No. 2, pp. 1-12.
Katsuno et al., "Novel therapeutic approach for spinal and bulbar muscular atrophy (SBMA)," 2018, vol. 35, No. 4, pp. 427-430 and p. 431 containing English Abstract [5 total pages].
Kim et al. "A thermostable mutation located at the hydrophobic core of a1-antitrypsin suppresses the folding defect of the Z-type variant." Journal of Biological Chemistry, Feb. 9, 1995, vol. 270, No. 15, pp. 8597-8601.
Kim et al., "Characterization and suppression of dysfunctional human a1-antitrypsin variants," Biochemical and Biophysical Research Communications, Apr. 2006, vol. 343, No. 1, pp. 295-302.
Kim et al., "Highly efficient RNA-guided base editing in mouse embryos," Nature Biotechnology, 2017, pp. 1-4.
Kim et al. (2017), Supplementary Information. (Year: 2017) (29 pages).
Kim et al., "Genome-wide target specificity of CRISPR RNA-guided adenine base editors," Nature Biotechnology, Apr. 2019, vol. 37, pp. 430-435.
Kitko et al., "Preparing the Patient for HSCT: Conditioning Regimens and Their Scientific Rationale," Hematopoietic Stem Cell Transplantation for the Pediatric Hematologist/Oncologist, 2018, pp. 139-174.
Kleinstiver et al., "Engineered CRISPR-Cas9 nucleases with altered PAM specificities," Nature, Jul. 23, 2015, vol. 523, Article No. 7561, pp. 481-485 and pp. 24-27 containing Figures (27 total pages).
Knapp et al., "Single-cell analysis identifies a CD33+ subset of human cord blood cells with high regenerative potential," Nature Cell Biology, Jun. 2018, vol. 20, pp. 710-720.
Knipping et al., "Disruption of HIV-1 co-receptors CCR5 and CXCR4 in primary human T cells and hematopoietic stem and progenitor cells using base editing." Molecular Therapy, Jan. 2022, vol. 30 No. 1, pp. 130-144 and Supplemental Information pp. 1-16 (31 pages total).
Komor et al., "Programmable Editing of a Target Base in Genomic DNA without Double-Stranded DNA Cleavage," Nature, May 19, 2016, vol. 533, pp. 420-424 and pp. 425-436 containing Methods and Figures (25 total pages).
Komor et al., "Editing the Genome Without Double-Stranded DNA Breaks," ACS Chemical Biology, 2018, vol. 13, pp. 383-388.
Konermann et al. "Optical Control of Mammalian Endogenous Transcription and Epigenetic States," Nature, Aug. 2013, vol. 50, No. 7463, pp. 472-476.
Krokan et al., "Uracil in DNA—occurrence, consequences and repair," Oncogene, 2002, vol. 21, pp. 8935-8948.
Kuscu et al., "CRISPR-Cas9-AID base editor is a powerful gain-of-function screening tool," Nature Methods, Dec 2016, vol. 13, No. 12, pp. 983-984.
Kuscu et al., "CRISPR-STOP: gene silencing through base-editing-induced nonsense mutations," Nature Methods, 2017, pp. 1-5.
Kwart et al., "Precise and efficient scarless genome editing in stem cells using CORRECT," Nature Protocols, 2017, vol. 12, No. 2, pp. 329-354.
Kwon et al., "Anti-human CD117 antibody-mediated bone marrow niche clearance in nonhuman primates and humanized NSG mice," Blood, May 9, 2019, vol. 133, No. 19, pp. 2104-2108.
Lagresle-Peyrou et al., "Plerixafor enables the safe, rapid, efficient mobilization of haematopoietic stem cells in sickle cell disease patients after exchange transfusion," Haematologica, 2018, vol. 103, No. 5, pp. 778-786, supplemental pp. 1-10.
Lau et al., "In vivo epigenome editing and transcriptional modulation using CRISPR technology." Transgenic Res, Oct. 2018, vol. 27, pp. 489-509.
Lebron et al., "A human monoclonal antibody targeting the stem cell factor receptor (c-Kit) blocks tumor cell signaling and inhibits tumor growth." Cancer Biology & Therapy, 2014, vol. 15, No. 9, pp. 1208-1218.
Lee et al., "Probing the native strain in a1-antitrypsin." Nature Structural Biology, Jun. 1996, vol. 3, No. 6, pp. 497-500.
Lee et al., "Cytosine base editor 4 but not adenine base editor generates off-target mutations in mouse embryos," Communications Biology, 2020, vol. 3, No. 19, pp. 1-6.
Leung et al., "Notch and AHR Signaling Impact Definitive Hematopoiesis from Human Pluripotent Stem Cells," StemCells, 2018, pp. 1-22.

(56) References Cited

OTHER PUBLICATIONS

Levasseur et al., "Correction of a mouse model of sickle cell disease: lentiviral/antisickling ß-globin gene transduction of unmobilized, purified hematopoietic stem cells," Blood, Dec 15, 2003, vol. 102, No. 13, pp. 4312-4319.
Levasseur et al., "A Recombinant Human Hemoglobin with Anti-sickling Properties Greater than Fetal Hemoglobin," The Journal of Biological Chemistry, Jun. 25, 2004, vol. 279, No. 26, p. 27518-27524.
Levi et al., "Treosulfan induces distinctive gonadal toxicity compared with busulfan," Oncotarget, 2018, vol. 9, No. 27, p. 19317-19327.
Lewis et al., "Cytosine deamination and the precipitous decline of spontaneous mutation during Earth's history," Proceedings of the National Academy of Sciences of the United States of America, Jul. 19, 2019, vol. 113, No. 29, pp. 8194-8199.
Li et al., "Gene Therapy Advances of CRISPR/Cas9 in B-thalassaemia," International Journal of Gynecology & Obstetrics, Apr. 2017, vol. 44, No. 2, pp. 185-188 [English Abstract].
Li et al., "Isolation and transcriptome analyses of human erythroid progenitors: BFU-E and CFU-E," Blood, Dec 4, 2014, vol. 124, No. 24, pp. 3636-3645.
Li et al., "Highly efficient and precise base editing in discarded human tripronuclear embryos," Protein& Cell, 2017, vol. 8, No. 10, pp. 776-779.
Li et al. "Base editing with a Cpf1-cytidine deaminase fusion." Nature biotechnology, 2018, vol. 36, No. 4, pp. 324-327.
Li et al., "Reactivation of γ-globin in adult ß-YAC mice after ex vivo and in vivo hematopoietic stem cell genome editing," Blood, Jun. 28, 2018, vol. 131, No. 26, pp. 2915-2928.
Li, et al. "Disruption of splicing-regulatory elements using CRISPR/Cas9 to rescue spinal muscular atrophy in human iPSCs and mice," National Science Review, 2020, vol. 7, Article No. 1, pp. 92-101.
Liang et al., "Correction of B-thalassemia mutant by base editor in human embryos," Protein & Cell, 2017, vol. 8, No. 11, pp. 811-822.
Lidonnici et al., "Gene therapy and gene editing strategies for hemoglobinopathies," Blood Cells, Molecules, and Diseases, 2017, vol. 70, pp. 1-74.
Lidonnici et al., "Plerixafor and G-CSF combination mobilizes hematopoietic stem and progenitors cells with a distinct transcriptional profile and a reduced in vivo homing capacity compared to plerixafor alone," Haematologica, 2017, vol. 102, pp. e120-e124.
Lim et al., "Applications of CRISPR/Cas9 for the Treatment of Duchenne Muscular Dystrophy," Journal of Personalized Medicine, 2018, vol. 8, Article No. 38, pp. 1-20.
Lim et al., "Treatment of a Mouse Model of ALS by In Vivo Base Editing," Molecular Therapy, Mar. 2020, vol. 28, No. 3, pp. 1177-1189.
Lin et al. "Structure-function relations in glucagon. Properties of highly purified Des-his1-, monoiodo-, and [Des-Asn28, Thr29](homoserine lactone27)-glucagon." Biochemistry vol. 14, No. 8, 1975, pp. 1559-1563.
Lin et al., "Base editing-mediated splicing correction therapy for spinal muscular atrophy", Cell Research, vol. 30, No. 6, Mar. 24, 2020 (Mar. 24, 2020), pp. 548-550.
Couch et al., "Human erythroblasts with c-Kit activating mutations have reduced cell culture costs and remain capable of terminal maturation," Experimental Hematology, Jun. 2019, vol. 74, pp. 19-24 and p. 24.e1-24.e4 containing Supplemental Methods and Supplemental References (10 total pages).
Cyranoski, David, "Blood stem cells produced in vast quantities in the lab," Nature, Jun. 6, 2019, vol. 570, pp. 17-18.
Czechowicz et al., "Selective hematopoietic stem cell ablation using CD117-antibody-drug-conjugates enables safe and effective transplantation with immunity preservation," Nature Communications, 2019, vol. 10, No. 617, pp. 1-21.
Davis et al., "Small molecule-triggered Cas9 protein with improved genome-editing specificity," Nature Chemical Biology, May 2015, vol. 11, No. 5, pp. 316-318.
Dever et al., "CRISPR/Cas9 B-globin gene targeting in human haematopoietic stem cells," Nature, Nov. 17, 2016, vol. 539, pp. 384-389.
Dever et al., "Preclinical Development of HBB Gene Correction in Autologous Hematopoietic Stem and Progenitor Cells to Treat Severe Sickle Cell Disease," Blood, 2017, vol. 130, No. Suppl. 1, p. 4620.
Devi et al., "Neutrophil mobilization via plerixafor-mediated CXCR4 inhibition arises from lung demargination and blockade of neutrophil homing to the bone marrow," The Journal of Experimental Medicine, 2013, vol. 210, No. 11, pp. 2321-2336.
Dewitt et al., "Selection-free Genome Editing of the Sickle Mutation in Human Adult Hematopoietic Stem/Progenitor Cells," Science Translational Medicine, Oct. 12, 2016, vol. 8, No. 360, pp. 1-20.
Didonato et al., "Complete Nucleotide Sequence, Genomic Organization, and Promoter Analysis of the Murine Survival Motor Neuron Gene (Smn)," Mammalian Genome, 1999, vol. 10, pp. 638-641.
Doulatov et al., "Revised map of the human progenitor hierarchy shows the origin of macrophages and dendritic cells in early lymphoid development," Nature Immunology, Jul. 2010, vol. 11, No. 7, pp. 585-593.
Du et al., "Biomarker signatures of sickle cell disease severity," Blood Cells, Molecules and Diseases, 2018, vol. 72, pp. 1-9.
Eaton et al., "Treating sickle cell disease by targeting HbS polymerization," Blood, May 18, 2017, vol. 129, No. 20, pp. 2719-2726.
Edison et al., "A novel B-globin gene mutation HBB.c22 G>C produces a hemoglobin variant (Hb Vellore) mimicking HbS in HPLC," International Journal of Laboratory Hematology, 2012, vol. 34, pp. 556-558.
Elias and Huang, Biochemical and Structural Studies of A-to-I Editing by tRNA:A34 Deaminases at the Wobble Position of Transfer RNA Biochemistry (2005), 44: 12057-12065 (Year: 2005).
Ema et al., "Repopulation dynamics of single haematopoietic stem cells in mouse transplantation experiments: Importance of stem cell composition in competitor cells," Journal of Theoretical Biology, 2016, vol. 394, pp. 57-67.
ENA Accession No. BDB43378, downloaded Apr. 24, 2023.
Engelward et al., "Base excision repair deficient mice lacking the Aag alkyladenine DNA glycosylase," Proceedings of the National Academy of Sciences of the United States of America, Nov. 1997, vol. 94, pp. 13087-13092.
Esrick et al., "Successful hematopoietic stem cell mobilization and apheresis collection using plerixafor alone in sickle cell patients," Blood Advances, Oct. 9, 2018, vol. 2, No. 19, pp. 2505-2512.
Esvelt et al., "A system for the continuous directed evolution of biomolecules". Nature, 2011, vol. 472, pp. 499-503.
Fagagna et al., "The Gam protein of bacteriophage Mu is an orthologue of eukaryotic Ku," EMBO reports, 2003, vol. 4, No. 1, pp. 47-52.
FDA, "Fda approves crizanlizumab-tmca for sickle cell disease," Food and Drug Administration (FDA), Nov. 15, 2019, <https://www.fda.gov/drugs/resources-information-approved-drugs/fda-approves-crizanlizumab-tmca-sickle-cell-disease>.
Fine et al., "Trans-spliced Cas9 allows cleavage of HBB and CCR5 genes in human cells using compact expression cassettes," Scientific Reports, Jul. 2015, vol. 5, No. 1, pp. 1-9 and Supplemental Info, pp. 1-8 (17 pages total).
Finn. JD, et al. A Single Administration of CRISPR/Cas9 Lipid Nanoparticles Achieves Robust and Persistent In Vivo Genome Editing. Cell Reports. Feb. 27, 2018; 22(9):2227-2235. doi:10.1016/j.celrep.2018.02.014.
Fiorini et al., "Developmentally-faithful and effective human erythropoiesis in immunodeficient and Kit mutant mice," American Journal of Hematology, 2017, vol. 92, pp. E513-E519.
Fitzhugh et al., "Granulocyte Colony-Stimulating Factor (G-CSF) Administration in Individuals with Sickle Cell Disease: Time for a Moratorium?" Cytotherapy, 2009, vol. 11, Article No. 4, pp. 464-471.
Forget, Bernard G., "Molecular Basis of Hereditary Persistence of Fetal Hemoglobin," Annals of the New York Academy of Sciences, 1998, vol. 850, No. 1, pp. 38-44.

(56) References Cited

OTHER PUBLICATIONS

Fukui et al., "DNA Mismatch Repair in Eukaryotes and Bacteria," Journal of Nucleic Acids, 2010, vol. 2010, No. 260512, pp. 1-16.

Gaj et al., "In vivo genome editing improves motor function and extends survival in a mouse model of ALS," Science Advances, Dec 20, 2017, vol. 3, Article No. eaar3952, pp. 1-10.

Gao, et al., "DNA-guided genome editing using the Natronobacterium gregoryi Argonaute." Nature biotechnology, May 2, 2016, vol. 34 No. 7, pp. 768-773.

Gapinske et al., "CRISPR-SKIP: programmable gene splicing with single base editors." Genome biology, 2018, vol. 19, No. 107, pp. 1-11.

Gaudelli et al., "Programmable Base Editing of A.T to G.C in Genomic DNA without DNA Cleavage," Nature, Nov. 23, 2017, vol. 551, pp. 464-471 and pp. 472-487 containing Methods, Figures, Life Sciences Reporting Summary and Corrections & Amendments (37 total pages).

GenBank. "Apobec1 [Pongo Pygmaeus] —Protein—NCBI." Nih. gov, 2019, www.ncbi.nlm.nih.gov/protein/AAT44389.1? report= genbank&log. Accessed Apr. 25, 2025. (Year: 2019).

GenBank Accession No. J026191.1 Human Z type alpha-1-antitrypsin gene, complete eds (exons 2-5); https://www.ncbi.nlm.nih.gov/nucleotide/J02619.1 [retrieved Mar. 17, 2025], available Oct. 30, 1994 (Year: 1994).

George et al., "Adenosine Deaminases Acting on RNA, RNA Editing, and Interferon Action," Journal of Interferon & Cytokine Research, 2011, vol. 31, No. 1, pp. 99-117.

Gerber et al., "An Adenosine Deaminase that Generates Inosine at the Wobble Position of tRNAs," Science, Nov. 5, 1999, vol. 286, pp. 1146-1149.

Geu-Flores et al., "USER fusion: a rapid and efficient method for simultaneous fusion and cloning of multiple PCR products," Nucleic Acids Research, 2007, vol. 35, No. 7, e55, pp. 1-6.

Giralt et al., "Optimizing Autologous Stem Cell Mobilization Strategies to Improve Patient Outcomes: Consensus Guidelines and Recommendations," Biology of Blood and Marrow Transplantation, 2014, vol. 20, pp. 295-308.

Gladman et al., "A humanized Smn gene containing the SMN2 nucleotide alteration in exon 7 mimics SMN2 splicing and the SMA disease phenotype," Human Molecular Genetics, 2010, vol. 19, No. 21, pp. 4239-4252.

Gluckman et al., "Sickle cell disease: an international survey of results of HLA-identical sibling hematopoietic stem cell transplantation," Blood, Mar. 16, 2017, vol. 129, No. 11, pp. 1548-1556.

Goldstein et al., "In Situ Modification of Tissue Stem and Progenitor Cell Genomes," Cell Reports, Apr. 23, 2019, vol. 27, pp. 1254-1264.

Grevet et at, "Domain-focused CRISPR screen identifies HRI as a fetal hemoglobin regulator in human erythroid cells," Science, Jul. 20, 2018, vol. 361, pp. 285-290.

Grunebaum et al., "Recent advances in understanding and managing adenosine deaminase and purine nucleoside phosphorylase deficiencies," Current Opinion in Allergy and Clinical Immunology, Dec 2013, vol. 13, No. 6, pp. 630-638.

Guiu et al., "Tracing the origin of adult intestinal stem cells," Nature, Jun. 6, 2019, vol. 570, pp. 107-111.

Haubner et al., "Coexpression profile of leukemic stem cell markers for combinatorial targeted therapy in AML," Leukemia, 2019, vol. 33, pp. 64-74.

Hawksworth et al., "Enhancement of red blood cell transfusion compatibility using CRISPR-mediated erythroblast gene editing," EMBO Molecular Medicine, 2018, vol. 10, No. e8454, pp. 1-11.

Hirano Seiichi et al., "Structural Basis for the Altered PAM Specificities of Engineered CRISPR-Cas9", Molecular Cell, vol. 61, No. 6, pp. 886-894. 2016.

Hirose et al., "Immortalization of Erythroblasts by c-MYC and BCL-XL Enables Large-Scale Erythrocyte Production from Human Pluripotent Stem Cells," Stem Cell Reports, Dec 17, 2013, vol. 1, pp. 499-508.

Hoban et al., "Genetic treatment of a molecular disorder: gene therapy approaches to sickle cell disease," Blood, Feb. 18, 2016, vol. 127, No. 7, pp. 839-848.

Hogan et al., "Differential long-term and multilineage engraftment potential from subtractions of human CD34+ cord blood cells transplanted into NOD/SCID mice," Proceedings of the National Academy of Sciences of the United States of America, Jan. 8, 2002, vol. 99, No. 1, pp. 413-418.

Hoggatt et al., "Rapid Mobilization Reveals a Highly Engraftable Hematopoietic Stem Cell,"vol. 172, pp. 191-204.

* cited by examiner

METHODS OF EDITING NUCLEOTIDE POLYMORPHISM USING PROGRAMMABLE BASE EDITOR SYSTEMS

RELATED APPLICATIONS

This application is the U.S. national phase application, pursuant to 35 U.S.C. § 371, of PCT International Application No.: PCT/US2019/031899, filed May 11, 2019, designating the United States and published in English, which claims priority to and benefit of U.S. Provisional Applications U.S. Ser. No. 62/670,588, filed May 11, 2018; U.S. Ser. No. 62/780,838, filed Dec. 17, 2018; and U.S. Ser. No. 62/817,986, filed Mar. 13, 2019, each of which is incorporated herein by reference in its entirety.

SEQUENCE LISTING

The instant application contains a Sequence Listing which has been submitted electronically in ASCII format and is hereby incorporated by reference in its entirety. The ASCII copy, created on Mar. 12, 2025, is named 180802-042505US_SL.txt and is 660,030 bytes in size.

BACKGROUND OF THE DISCLOSURE

Rett Syndrome (RTT or RETT) is caused by a heterogeneous group of mutations in the methyl-CpG-binding protein 2 (Mecp2) gene that impair or abrogate the encoded protein's ability to modify chromatin and transcriptional states in the central nervous system (CNS). Gene therapy to deliver functional Mecp2 or using RNA editing to repair the endogenous Mecp2 mRNA transcripts are promising approaches to therapeutic interventions when delivered broadly throughout the CNS. However, both approaches must overcome significant challenges to achieve therapeutic efficacy. Mecp2 gene therapy must tightly control the dosage of the delivered gene on a per-cell basis or risk mimicking the phenotype of Mecp2 duplication syndrome. RNA editing platforms are unable to precisely correct the most prevalent Mecp2 mutations accounting for more than 45% of RTT diagnoses and also induce efficient, unguided off-target editing.

The genetic mutations in Mecp2 that cause Rett Syndrome (RTT) are highly heterogeneous. As a consequence, the favored strategy for therapy has been to deliver wild-type Mecp2 carried by recombinant adeno-associated virus (rAAV). Because this strategy is agnostic to the causal mutation in each individual, a successful gene therapy approach would provide a therapeutic option to a large portion of the RTT patient population. To date, however, this strategy has been met with limited success. RTT patients are nearly always heterozygotic females, resulting in characteristic wild-type and mutant X-linked MeCP2 mosaic expression within the central nervous system (CNS) due to random X-chromosome inactivation. Thus, rAAV delivery and expression of wild-type MeCP2 in neurons already expressing wild-type MeCP2 is likely to partially mimic the phenotype of MeCP2 duplication syndrome. Consistent with this, high transduction efficiency in the CNS of RTT-model mice resulted in approximately 2-fold greater MeCP2 expression than found in wild-type mice.

Therefore, there is a need for novel compositions and methods for treating patients with Rett Syndrome.

INCORPORATION BY REFERENCE

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

SUMMARY OF THE DISCLOSURE

As described below, the present invention features compositions and methods for the precise correction of pathogenic amino acids using a programmable nucleobase editor. In particular, the compositions and methods of the invention are useful for the treatment of Rett Syndrome (RTT). Thus, the invention provides compositions and methods for treating Rett Syndrome using an adenosine (A) base editor (ABE) to precisely correct a single nucleotide polymorphism in the endogenous Mecp2 gene to correct a deleterious mutation (e.g., R133C, T158M, R255*, R270*, R306C).

In one aspect, the invention provides a method of editing an MECP2 polynucleotide containing a single nucleotide polymorphism (SNP) associated with Rett Syndrome (RTT), the method involving contacting the MECP2 polynucleotide with a base editor in complex with one or more guide polynucleotides, where the base editor includes a polynucleotide programmable DNA binding domain and an adenosine deaminase domain, and where one or more of the guide polynucleotides target the base editor to effect an A•T to G•C alteration of the SNP associated with RTT.

In another aspect, the invention provides a cell produced by introducing into the cell, or a progenitor thereof: a base editor, or a polynucleotide encoding the base editor, to the cell, where the base editor includes a polynucleotide programmable DNA binding domain and an adenosine deaminase domain; and one or more guide polynucleotides that target the base editor to effect an A•T to G•C alteration of the SNP associated with RTT.

In another aspect, the invention provides a method of treating RTT in a subject involving administering to said subject: a base editor, or a polynucleotide encoding the base editor, to the subject, where the base editor includes a polynucleotide programmable DNA binding domain and an adenosine deaminase domain; and one or more guide polynucleotides that target the base editor to effect an A•T to G•C alteration of the SNP associated with RTT.

In another aspect, the invention provides a base editor comprising: (i) a modified SpCas9 comprising the amino acid substitutions L1111R, D1135V, G1218R, E1219F, A1322R, R1335V, T1337R and one or more of L1111, D1135L, S1136R, G1218S, E1219V, D1332A, R1335Q, T1337, T1337L, T1337Q, T13371, T1337V, T1337F, and T1337M, or corresponding amino acid substitutions thereof; and (ii) an adenosine deaminase.

In another aspect, the invention provides a base editor comprising: (i) a modified SpCas9 comprising the amino acid substitutions D1135L, S1136R, G1218S, E1219V, A1322R, R1335Q, and T1337, and one or more of L1111R, G1218R, E1219F, D1332A, D1332S, D1332T, D1332V, D1332L, D1332K, D1332R, T1337L, T1337I, T1337V, T1337F, T1337S, T1337N, T1337K, T1337R, T1337H, T1337Q, and T1337M, or corresponding amino acid substitutions thereof; and (ii) an adenosine deaminase.

In various embodiments, the contacting is in a cell, a eukaryotic cell, a mammalian cell, or human cell. In various embodiments, the cell is in vivo or ex vivo. In various embodiments, the alteration is one or more of R106W, R168*, R133C, T158M, R255*, R270*, and R306C. In various embodiments, the A•T to G•C alteration at the SNP associated with RTT changes a cysteine to an arginine, methionine to a threonine, or stop codon to arginine in the methyl CpG binding protein 2 (MeCP2) polypeptide. In various embodiments, the SNP associated with RTT results in expression of an Mecp2 polypeptide comprising an arginine at amino acid position 168, 133, 255, 270, or 306; or a threonine at position 158. In various embodiments, the polynucleotide programmable DNA binding domain is a *Streptococcus pyogenes* Cas9 (SpCas9) or variant thereof. In various embodiments, the polynucleotide programmable DNA binding domain comprises a modified SpCas9 having an altered protospacer-adjacent motif (PAM) specificity. In various embodiments, the altered PAM has specificity for the nucleic acid sequence 5'-NGT-3'. In various embodiments, the modified SpCas9 comprises the amino acid substitutions L1111R, D1135V, G1218R, E1219F, A1322R, R1335V, T1337R and one or more of L1111, D1135L, S1136R, G1218S, E1219V, D1332A, D1332S, D1332T, D1332V, D1332L, D1332K, D1332R, R1335Q, T1337, T1337L, T1337Q, T1337I, T1337V, T1337F, T1337S, T1337N, T1337K, T1337H, T1337Q, and T1337M, or corresponding amino acid substitutions thereof. In various embodiments, the modified SpCas9 comprises the amino acid substitutions D1135L, 51136R, G1218S, E1219V, A1322R, R1335Q, and T1337, and one or more of L1111R, G1218R, E1219F, D1332A, D1332S, D1332T, D1332V, D1332L, D1332K, D1332R, T1337L, T1337I, T1337V, T1337F, T1337S, T1337N, T1337K, T1337R, T1337H, T1337Q, and T1337M, or corresponding amino acid substitutions thereof. In various embodiments, the polynucleotide programmable DNA binding domain is a nuclease inactive or nickase variant. In various embodiments, the nickase variant comprises an amino acid substitution D10A or a corresponding amino acid substitution thereof. In various embodiments, the adenosine deaminase domain is capable of deaminating adenosine in deoxyribonucleic acid (DNA). In various embodiments, the adenosine deaminase is a modified adenosine deaminase that does not occur in nature. In various embodiments, the adenosine deaminase is a TadA deaminase. In various embodiments, the TadA deaminase is TadA*7.10. In various embodiments, the one or more guide RNAs comprises a CRISPR RNA (crRNA) and a trans-encoded small RNA (tracrRNA), where the crRNA comprises a nucleic acid sequence complementary to a Mecp2 nucleic acid sequence comprising the SNP associated with RTT. In various embodiments, the base editor is in complex with a single guide RNA (sgRNA) comprising a nucleic acid sequence complementary to an Mecp2 nucleic acid sequence comprising the SNP associated with RTT. In various embodiments, the cell is a neuron. In various embodiments, the neuron expresses an Mecp2 polypeptide. In various embodiments, the cell is from a subject having RTT.

BRIEF DESCRIPTION OF THE DRAWINGS

The features of the present disclosure are set forth with particularity in the appended claims. A better understanding of the features and advantages of the present will be obtained by reference to the following detailed description that sets forth illustrative embodiments, in which the principles of the disclosure are utilized, and the accompanying drawings of which:

DETAILED DESCRIPTION OF THE DISCLOSURE

Figure 1:
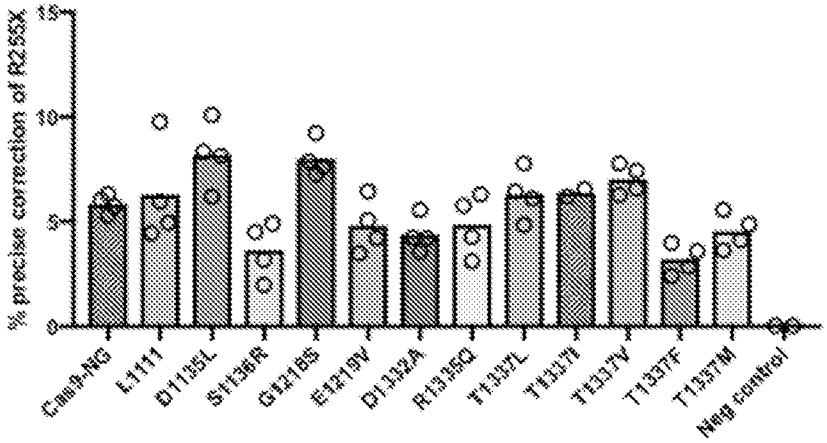
FIG. 1 is a graph depicting percentage of precise correction of R255X RTT mutation using base editor variants with specificity for NGT PAM.

Described herein are compositions and methods providing base editing and base editing systems to precisely correct one or more mutations in the methyl-CpG-binding protein 2 (Mecp2) gene, which is causally related to the progressive neurodevelopmental disorder Rett Syndrome (RTT) and its symptoms. RTT is an X-linked dominant disorder that predominantly affects females, is associated in 96% of affected individuals with mutations in the Mecp2 gene and is characterized by apparently normal early development followed by a regression with loss of fine motor skills and effective communication, stereotypic movements, and apraxia or complete absence of gait. Additional clinical features of afflicted individuals include abnormal postnatal deceleration in the rate of head growth, periodic breathing, gastrointestinal dysfunction, epilepsy, and scoliosis.

The most prevalent RTT-causing mutations are cytidine to thymidine (C→T) transition mutations, resulting in a C•G to T•A base pair substitution. This substitution may be reverted back to a wild-type, non-pathogenic genomic sequence with an adenosine base editor (ABE) which catalyzes A•T to G•C substitutions. By extension, highly prevalent RTT-causing mutations are potential targets for reversion to wild-type sequence using ABEs without the risks of inducing Mecp2 gene overexpression, as may occur using gene therapy. Accordingly, A•T to G•C DNA base editing has the potential to precisely correct one or more of the most prevalent RTT-causing mutations in the Mecp2 gene.

The following description and examples illustrate embodiments of the present disclosure in detail. It is to be understood that this disclosure is not limited to the particular embodiments described herein and as such can vary. Those of skill in the art will recognize that there are numerous variations and modifications of this disclosure, which are encompassed within its scope.

The section headings used herein are for organizational purposes only and are not to be construed as limiting the subject matter described.

Although various features of the present disclosure can be described in the context of a single embodiment, the features can also be provided separately or in any suitable combination. Conversely, although the present disclosure can be described herein in the context of separate embodiments for clarity, the present disclosure can also be implemented in a single embodiment.

Definitions

Unless defined otherwise, all technical and scientific terms as used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991).

In this application, the use of the singular includes the plural unless specifically stated otherwise. It must be noted that, as used in the specification, the singular forms "a," "an" and "the" include plural referents unless the context clearly dictates otherwise. In this application, the use of "or" means "and/or" unless stated otherwise. Furthermore, use of the term "including" as well as other forms, such as "include", "includes," and "included," is not limiting.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, preferably within 5-fold, and more preferably within 2-fold, of a value. Where particular values are described in the application and claims, unless otherwise stated the term "about" meaning within an acceptable error range for the particular value should be assumed.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium.

By "agent" is meant any small molecule chemical compound, antibody, nucleic acid molecule, or polypeptide, or fragments thereof.

By "ameliorate" is meant decrease, suppress, attenuate, diminish, arrest, or stabilize the development or progression of a disease.

By "alteration" is meant a change (increase or decrease) in the expression levels or activity of a gene or polypeptide as detected by standard art known methods such as those described herein. As used herein, an alteration includes a 10% change in expression levels, preferably a 25% change, more preferably a 40% change, and most preferably a 50% or greater change in expression levels.

By "analog" is meant a molecule that is not identical, but has analogous functional or structural features. For example, a polypeptide analog retains the biological activity of a corresponding naturally-occurring polypeptide, while having certain biochemical modifications that enhance the analog's function relative to a naturally occurring polypeptide. Such biochemical modifications could increase the analog's protease resistance, membrane permeability, or half-life, without altering, for example, ligand binding. An analog may include an unnatural amino acid.

"Administering" is referred to herein as providing one or more compositions described herein to a patient or a subject. By way of example and without limitation, composition administration, e.g., injection, can be performed by intravenous (i.v.) injection, sub-cutaneous (s.c.) injection, intradermal (i.d.) injection, intraperitoneal (i.p.) injection, or intramuscular (i.m.) injection. One or more such routes can be employed. Parenteral administration can be, for example, by bolus injection or by gradual perfusion over time. Alternatively, or concurrently, administration can be by the oral route.

By "cytidine deaminase" is meant a polypeptide or fragment thereof capable of catalyzing a deamination reaction that converts an amino group to a carbonyl group. In one embodiment, the cytidine deaminase converts cytosine to uracil or 5-methylcytosine to thymine. PmCDA1, which is derived from *Petromyzon marinus* (*Petromyzon marinus* cytosine deaminase 1, "PmCDA1"), AID (Activation-induced cytidine deaminase; AICDA), which is derived from a mammal (e.g., human, swine, bovine, horse, monkey etc.), and APOBEC are exemplary cytidine deaminases.

By "methyl CpG binding protein 2 (Mecp2) protein" is meant a polypeptide or fragment thereof having at least about 95% amino acid sequence identity to NCBI Accession No. NP_004983. In particular embodiments, an Mecp2 protein comprises one or more alterations relative to the following reference sequence. In particular embodiments, an Mecp2 protein associated with RTT comprises one or more mutations selected from R106W, R168*, R133C, T158M, R255*, R270*, and R306C. An exemplary Mecp2 amino acid sequence is provided below.

```
                                                          (SEQ ID NO: 1)
  1  mvagmlglre eksedqdlqg lkdkplkfkk vkkdkkeeke gkhepvqpsa hhsaepaeag
 61  kaetsegsgs apavpeasas pkqrrsiird rgpmyddptl pegwtrklkq rksgrsagky
121  dvylinpqgk afrskvelia yfekvgdtsl dpndfdftvt grgspsrreq kppkkpkspk
181  apgtgrgrgr pkgsgttrpk aatsegvqvk rvlekspgkl lvkmpfqtsp ggkaegggat
241  tstqvmvikr pgrkrkaead pqaipkkrgr kpgsvvaaaa aeakkkavke ssirsvqetv
301  lpikkrktre tvsievkevv kpllvstlge ksgkglktck spgrkskess pkgrsssass
361  ppkkehhhhh hhsespkapv pllpplpppp pepessedpt sppepqdlss svckeekmpr
421  ggslesdgcp kepaktqpav ataataaeky khrgegerkd ivsssmprpn reepvdsrtp
481  vtervs
```

By "Mecp2 polynucleotide" is meant a nucleic acid molecule encoding an Mecp2 protein or fragment thereof. The sequence of an exemplary Mecp2 polynucleotide, which is available at NCBI Accession No. NM_004992, is provided below. In particular embodiments, an Mecp2 polynucleotide comprises one or more alterations relative to the following reference sequence. In particular embodiments, an Mecp2 polynucleotide associated with RTT comprises one or more mutations selected from 316C>T, 397C>T, 473C>T, 763C>T, 808C>T and 916C>T.

```
                                                          (SEQ ID NO: 2)
   1  ccggcgtcgg cggcgcgcgc gctccctcct ctcggagaga gggctgtggt aaaagccgtc
  61  cggaaaatgg ccgccgccgc cgccgccgcg ccgagcggag gaggaggagg aggcgaggag
 121  gagagactgc tccataaaaa tacagactca ccagttcctg ctttgatgtg acatgtgact
 181  ccccagaata caccttgctt ctgtagacca gctccaacag gattccatgg tagctgggat
 241  gttagggctc agggaagaaa agtcagaaga ccaggacctc cagggcctca aggacaaacc
 301  cctcaagttt aaaaaggtga agaaagataa gaaagaagag aaagagggca agcatgagcc
 361  cgtgcagcca tcagcccacc actctgctga gcccgcagag gcaggcaaag cagagacatc
 421  agaagggtca ggctccgccc cggctgtgcc ggaagcttct gcctccccca aacagcggcg
 481  ctccatcatc cgtgaccggg gacccatgta tgatgacccc accctgcctg aaggctggac
 541  acggaagctt aagcaaagga aatctggccg ctctgctggg aagtatgatg tgtatttgat
 601  caatccccag ggaaaagcct ttcgctctaa agtggagttg attgcgtact tcgaaaaggt
 661  aggcgacaca tccctggacc ctaatgattt tgacttcacg gtaactggga gagggagccc
 721  ctcccggcga gagcagaaac cacctaagaa gcccaaatct cccaaagctc caggaactgg
 781  cagaggccgg ggacgcccca aagggagcgg caccacgaga cccaaggcgg ccacgtcaga
 841  gggtgtgcag gtgaaaaggg tcctggagaa aagtcctggg aagctccttg tcaagatgcc
 901  ttttcaaact tcgccagggg gcaaggctga ggggggtggg gccaccacat ccacccaggt
 961  catggtgatc aaacgccccg gcaggaagcg aaaagctgag gccgaccctc aggccattcc
1021  caagaaacgg ggccgaaagc cggggagtgt ggtggcagcc gctgccgccg aggccaaaaa
1081  gaaagccgtg aaggagtctt ctatccgatc tgtgcaggag accgtactcc ccatcaagaa
1141  gcgcaagacc cgggagacgg tcagcatcga ggtcaaggaa gtggtgaagc ccctgctggt
```

-continued

```
1201   gtccaccctc ggtgagaaga gcgggaaagg actgaagacc tgtaagagcc ctgggcggaa
1261   aagcaaggag agcagcccca aggggcgcag cagcagcgcc tcctcacccc ccaagaagga
1321   gcaccaccac catcaccacc actcagagtc ccccaaaggcc cccgtgccac tgctcccacc
1381   cctgccccca cctccacctg agcccgagag ctccgaggac ccccaccagcc cccctgagcc
1441   ccaggacttg agcagcagcg tctgcaaaga ggagaagatg cccagaggag gctcactgga
1501   gagcgacggc tgccccaagg agccagctaa gactcagccc gcggttgcca ccgccgccac
1561   ggccgcagaa aagtacaaac accgagggga gggagagcgc aaagacattg tttcatcctc
1621   catgccaagg ccaaacagag aggagcctgt ggacagccgg acgcccgtga ccgagagagt
1681   tagctgactt tacacggagc ggattgcaaa gcaaaccaac aagaataaag gcagctgttg
1741   tctcttctcc ttatgggtag ggctctgaca aagcttcccg attaactgaa ataaaaaata
1801   tttttttttc tttcagtaaa cttagagttt cgtggcttca gggtgggagt agttggagca
1861   ttggggatgt ttttcttacc gacaagcaca gtcaggttga agacctaacc agggccagaa
1921   gtagctttgc acttttctaa actaggctcc ttcaacaagg cttgctgcag atactactga
1981   ccagacaagc tgttgaccag gcacctcccc tcccgcccaa acctttcccc catgtggtcg
2041   ttagagacag agcgacagag cagttgagag gacactcccg ttttcggtgc catcagtgcc
2101   ccgtctacag ctcccccagc tccccccacc tcccccactc ccaaccacgt tgggacaggg
2161   aggtgtgagg caggagagac agttggattc tttagagaag atggatatga ccagtggcta
2221   tggcctgtgc gatcccaccc gtggtggctc aagtctggcc ccacaccagc cccaatccaa
2281   aactggcaag gacgcttcac aggacaggaa agtggcacct gtctgctcca gctctggcat
2341   ggctaggagg ggggagtccc ttgaactact gggtgtagac tggcctgaac cacaggagag
2401   gatggcccag ggtgaggtgg catggtccat tctcaaggga cgtcctccaa cgggtggcgc
2461   tagaggccat ggaggcagta ggacaaggtg caggcaggct ggcctggggt caggccgggc
2521   agagcacagc ggggtgagag ggattcctaa tcactcagag cagtctgtga cttagtggac
2581   aggggagggg gcaaaggggg aggagaagaa aatgttcttc cagttacttt ccaattctcc
2641   tttaggacca gcttagaatt atttgcacta ttgagtcttc atgttcccac ttcaaaacaa
2701   acagatgctc tgagagcaaa ctggcttgaa ttggtgacat ttagtccctc aagccaccag
2761   atgtgacagt gttgagaact acctggattt gtatatatac ctgcgcttgt tttaaagtgg
2821   gctcagcaca tagggttccc acgaagctcc gaaactctaa gtgtttgctg caattttata
2881   aggacttcct gattggtttc tcttctcccc ttccatttct gccttttgtt catttcatcc
2941   tttcacttct ttcccttcct ccgtcctcct ccttcctagt tcatcccttc tcttccaggc
3001   agccgcggtg cccaaccaca cttgtcggct ccagtcccca gaactctgcc tgccctttgt
3061   cctcctgctg ccagtaccag ccccaccctg ttttgagccc tgaggaggcc ttgggctctg
3121   ctgagtccga cctggcctgt ctgtgaagag caagagagca gcaaggtctt gctctcctag
3181   gtagcccccct cttccctggt aagaaaaagc aaaaggcatt tcccaccctg aacaacgagc
3241   cttttcaccc ttctactcta gagaagtgga ctggaggagc tgggcccgat ttggtagttg
3301   aggaaagcac agaggcctcc tgtggcctgc cagtcatcga gtggcccaac aggggctcca
3361   tgccagccga ccttgacctc actcagaagt ccagagtcta gcgtagtgca gcagggcagt
3421   agcggtacca atgcagaact cccaagaccc gagctgggac cagtacctgg gtccccagcc
3481   cttcctctgc tccccctttt ccctcggagt tcttcttgaa tggcaatgtt ttgcttttgc
3541   tcgatgcaga cagggggcca gaacaccaca catttcactg tctgtctggt ccatagctgt
```

-continued

```
3601   ggtgtagggg cttagaggca tgggcttgct gtgggttttt aattgatcag ttttcatgtg
3661   ggatcccatc tttttaacct ctgttcagga agtccttatc tagctgcata tcttcatcat
3721   attggtatat ccttttctgt gtttacagag atgtctctta tatctaaatc tgtccaactg
3781   agaagtacct tatcaaagta gcaaatgaga cagcagtctt atgcttccag aaacacccac
3841   aggcatgtcc catgtgagct gctgccatga actgtcaagt gtgtgttgtc ttgtgtattt
3901   cagttattgt ccctggcttc cttactatgg tgtaatcatg aaggagtgaa acatcataga
3961   aactgtctag cacttccttg ccagtcttta gtgatcagga accatagttg acagttccaa
4021   tcagtagctt aagaaaaaac cgtgtttgtc tcttctggaa tggttagaag tgagggagtt
4081   tgccccgttc tgtttgtaga gtctcatagt tggactttct agcatatatg tgtccatttc
4141   cttatgctgt aaaagcaagt cctgcaacca aactcccatc agcccaatcc ctgatccctg
4201   atcccttcca cctgctctgc tgatgacccc cccagcttca cttctgactc ttccccagga
4261   agggaagggg ggtcagaaga gagggtgagt cctccagaac tcttcctcca aggacagaag
4321   gctcctgccc ccatagtggc ctcgaactcc tggcactacc aaaggacact tatccacgag
4381   agcgcagcat ccgaccaggt tgtcactgag aagatgttta ttttggtcag ttgggttttt
4441   atgtattata cttagtcaaa tgtaatgtgg cttctggaat cattgtccag agctgcttcc
4501   ccgtcacctg ggcgtcatct ggtcctggta agaggagtgc gtggcccacc aggccccccct
4561   gtcacccatg acagttcatt cagggccgat ggggcagtcg tggttgggaa cacagcattt
4621   caagcgtcac tttatttcat tcgggcccca cctgcagctc cctcaaagag gcagttgccc
4681   agcctctttc ccttccagtt tattccagag ctgccagtgg ggcctgaggc tccttagggt
4741   tttctctcta tttccccctt tcttcctcat tccctcgtct ttcccaaagg catcacgagt
4801   cagtcgcctt tcagcaggca gccttggcgg tttatcgccc tggcaggcag gggccctgca
4861   gctctcatgc tgcccctgcc ttggggtcag gttgacagga ggttggaggg aaagccttaa
4921   gctgcaggat tctcaccagc tgtgtccggc ccagttttgg ggtgtgacct caatttcaat
4981   tttgtctgta cttgaacatt atgaagatgg gggcctcttt cagtgaattt gtgaacagca
5041   gaattgaccg acagctttcc agtacccatg gggctaggtc attaaggcca catccacagt
5101   ctcccccacc cttgttccag ttgttagtta ctacctcctc tcctgacaat actgtatgtc
5161   gtcgagctcc ccccaggtct accccctcccg gccctgcctg ctggtgggct tgtcatagcc
5221   agtgggattg ccggtcttga cagctcagtg agctggagat acttggtcac agccaggcgc
5281   tagcacagct cccttctgtt gatgctgtat tcccatatca aaagacacag gggacaccca
5341   gaaacgccac atcccccaat ccatcagtgc caaactagcc aacggcccca gcttctcagc
5401   tcgctggatg gcggaagctg ctactcgtga gcgccagtgc gggtgcagac aatcttctgt
5461   tgggtggcat cattccaggc ccgaagcatg aacagtgcac ctgggacagg gagcagcccc
5521   aaattgtcac ctgcttctct gcccagcttt tcattgctgt gacagtgatg gcgaaagagg
5581   gtaataacca gacacaaact gccaagttgg gtggagaaag gagtttcttt agctgacaga
5641   atctctgaat tttaaatcac ttagtaagcg gctcaagccc aggagggagc agagggatac
5701   gagcggagtc ccctgcgcgg gaccatctgg aattggttta gcccaagtgg agcctgacag
5761   ccagaactct gtgtcccccg tctaaccaca gctccttttc cagagcattc cagtcaggct
5821   ctctgggctg actgggccag gggaggttac aggtaccagt tctttaagaa gatctttggg
5881   catatacatt tttagcctgt gtcattgccc caaatggatt cctgtttcaa gttcacacct
5941   gcagattcta ggacctgtgt cctagacttc agggagtcag ctgtttctag agttcctacc
6001   atggagtggg tctggaggac ctgcccggtg ggggggcaga gccctgctcc ctccgggtct
```

-continued 6061 tcctactctt ctctctgctc tgacgggatt tgttgattct ctccattttg gtgtctttct
6121 cttttagata ttgtatcaat ctttagaaaa ggcatagtct acttgttata aatcgttagg
6181 atactgcctc ccccagggtc taaaattaca tattagaggg gaaaagctga acactgaagt
6241 cagttctcaa caatttagaa ggaaaaccta gaaaacattt ggcagaaaat tacatttcga
6301 tgtttttgaa tgaatacgag caagctttta caacagtgct gatctaaaaa tacttagcac
6361 ttggcctgag atgcctggtg agcattacag gcaaggggaa tctggaggta gccgacctga
6421 ggacatggct tctgaacctg tcttttggga gtggtatgga aggtggagcg ttcaccagtg
6481 acctggaagg cccagcacca ccctccttcc cactcttctc atcttgacag agcctgcccc
6541 agcgctgacg tgtcaggaaa acacccaggg aactaggaag gcacttctgc ctgaggggca
6601 gcctgccttg cccactcctg ctctgctcgc ctcggatcag ctgagccttc tgagctggcc
6661 tctcactgcc tccccaaggc cccctgcctg ccctgtcagg aggcagaagg aagcaggtgt
6721 gagggcagtg caaggaggga gcacaacccc cagctcccgc tccgggctcc gacttgtgca
6781 caggcagagc ccagaccctg gaggaaatcc tacctttgaa ttcaagaaca tttggggaat
6841 ttggaaatct ctttgccccc aaacccccat tctgtcctac ctttaatcag gtcctgctca
6901 gcagtgagag cagatgaggt gaaaaggcca agaggtttgg ctcctgccca ctgatagccc
6961 ctctccccgc agtgtttgtg tgtcaagtgg caaagctgtt cttcctggtg accctgatta
7021 tatccagtaa cacatagact gtgcgcatag gcctgctttg tctcctctat cctgggcttt
7081 tgttttgctt tttagttttg cttttagttt ttctgtccct tttatttaac gcaccgacta
7141 gacacacaaa gcagttgaat ttttatatat atatctgtat attgcacaat tataaactca
7201 ttttgcttgt ggctccacac acacaaaaaa agacctgtta aaattatacc tgttgcttaa
7261 ttacaatatt tctgataacc atagcatagg acaagggaaa ataaaaaaag aaaaaaaaga
7321 aaaaaaaacg acaaatctgt ctgctggtca cttcttctgt ccaagcagat tcgtggtctt
7381 ttcctcgctt ctttcaaggg ctttcctgtg ccaggtgaag gaggctccag gcagcaccca
7441 ggttttgcac tcttgtttct cccgtgcttg tgaaagaggt cccaaggttc tgggtgcagg
7501 agcgctccct tgacctgctg aagtccggaa cgtagtcggc acagcctggt cgccttccac
7561 ctctgggagc tggagtccac tggggtggcc tgactccccc agtccccttc ccgtgacctg
7621 gtcagggtga gcccatgtgg agtcagcctc gcaggcctcc ctgccagtag ggtccgagtg
7681 tgtttcatcc ttcccactct gtcgagcctg gggggctggag cggagacggg aggcctggcc
7741 tgtctcggaa cctgtgagct gcaccaggta gaacgccagg gaccccagaa tcatgtgcgt
7801 cagtccaagg ggtcccctcc aggagtagtg aagactccag aaatgtccct ttcttctccc
7861 ccatcctacg agtaattgca tttgcttttg taattcttaa tgagcaatat ctgctagaga
7921 gtttagctgt aacagttctt tttgatcatc ttttttttaat aattagaaac accaaaaaaa
7981 tccagaaact tgttcttcca aagcagagag cattataatc accagggcca aaagcttccc
8041 tccctgctgt cattgcttct tctgaggcct gaatccaaaa gaaaaacagc cataggccct
8101 ttcagtggcc gggctacccg tgagcccttc ggaggaccag ggctggggca gcctctgggc
8161 ccacatccgg ggccagctcc ggcgtgtgtt cagtgttagc agtgggtcat gatgctcttt
8221 cccacccagc ctgggatagg ggcagaggag gcgaggaggc cgttgccgct gatgtttggc
8281 cgtgaacagg tgggtgtctg cgtgcgtcca cgtgcgtgtt ttctgactga catgaaatcg
8341 acgcccgagt tagcctcacc cggtgacctc tagccctgcc cggatggagc ggggcccacc
8401 cggttcagtg tttctgggga gctggacagt ggagtgcaaa aggcttgcag aacttgaagc -continued

```
8461   ctgctccttc ccttgctacc acggcctcct ttccgtttga tttgtcactg cttcaatcaa
8521   taacagccgc tccagagtca gtagtcaatg aatatatgac caaatatcac caggactgtt
8581   actcaatgtg tgccgagccc ttgcccatgc tgggctcccg tgtatctgga cactgtaacg
8641   tgtgctgtgt ttgctcccct tccccttcct tctttgccct ttacttgtct ttctggggtt
8701   tttctgtttg ggtttggttt ggtttttatt tctccttttg tgttccaaac atgaggttct
8761   ctctactggt cctcttaact gtggtgttga ggcttatatt tgtgtaattt ttggtgggtg
8821   aaaggaattt tgctaagtaa atctcttctg tgtttgaact gaagtctgta ttgtaactat
8881   gtttaaagta attgttccag agacaaatat ttctagacac tttttcttta caaacaaaag
8941   cattcggagg gagggggatg gtgactgaga tgagagggga gagctgaaca gatgacccct
9001   gcccagatca gccagaagcc acccaaagca gtggagccca ggagtcccac tccaagccag
9061   caagccgaat agctgatgtg ttgccacttt ccaagtcact gcaaaaccag gttttgttcc
9121   gcccagtgga ttcttgtttt gcttcccctc cccccgagat tattaccacc atcccgtgct
9181   tttaaggaaa ggcaagattg atgtttcctt gaggggagcc aggaggggat gtgtgtgtgc
9241   agagctgaag agctggggag aatggggctg ggcccaccca agcaggaggc tgggacgctc
9301   tgctgtgggc acaggtcagg ctaatgttgg cagatgcagc tcttcctgga caggccaggt
9361   ggtgggcatt ctctctccaa ggtgtgcccc gtgggcatta ctgtttaaga cacttccgtc
9421   acatcccacc ccatcctcca gggctcaaca ctgtgacatc tctattcccc accctcccct
9481   tcccagggca ataaaatgac catggagggg gcttgcactc tcttggctgt caccccgatcg
9541   ccagcaaaac ttagatgtga gaaaacccct tcccattcca tggcgaaaac atctccttag
9601   aaaagccatt accctcatta ggcatggttt tgggctccca aaacacctga cagcccctcc
9661   ctcctctgag aggcggagag tgctgactgt agtgaccatt gcatgccggg tgcagcatct
9721   ggaagagcta ggcagggtgt ctgccccctc ctgagttgaa gtcatgctcc cctgtgccag
9781   cccagaggcc gagagctatg gacagcattg ccagtaacac aggccaccct gtgcagaagg
9841   gagctggctc cagcctggaa acctgtctga ggttgggaga ggtgcacttg gggcacaggg
9901   agaggccggg acacacttag ctggagatgt ctctaaaagc cctgtatcgt attcaccttc
9961   agtttttgtg ttttgggaca attactttag aaaataagta ggtcgtttta aaaacaaaaa
10021  ttattgattg ctttttgta gtgttcagaa aaaaggttct ttgtgtatag ccaaatgact
10081  gaaagcactg atatatttaa aaacaaaagg caatttatta aggaaatttg taccatttca
10141  gtaaacctgt ctgaatgtac ctgtatacgt ttcaaaaaca cccccccccc actgaatccc
10201  tgtaacctat ttattatata aagagtttgc cttataaatt t
```

By "base editor (BE)," or "nucleobase editor (NBE)" is meant an agent that binds a polynucleotide and has nucleobase modifying activity. In various embodiments, the base editor comprises a nucleobase modifying polypeptide (e.g., a deaminase) and a polynucleotide programmable nucleotide binding domain in conjunction with a guide polynucleotide (e.g., guide RNA). In various embodiments, the agent is a biomolecular complex comprising a protein domain having base editing activity, i.e., a domain capable of modifying a base (e.g., A, T, C, G, or U) within a nucleic acid molecule (e.g., DNA). In some embodiments, the polynucleotide programmable DNA binding domain is fused or linked to a deaminase domain. In one embodiment, the agent is a fusion protein comprising a domain having base editing activity. In another embodiment, the protein domain having base editing activity is linked to the guide RNA (e.g., via an RNA binding motif on the guide RNA and an RNA binding domain fused to the deaminase). In some embodiments, the domain having base editing activity is capable of deaminating a base within a nucleic acid molecule. In some embodiments, the base editor is capable of deaminating a base within a DNA molecule. In some embodiments, the base editor is capable of deaminating a cytosine (C) or an adenosine (A) within DNA. In some embodiments, the base editor is a cytidine base editor (CBE). In some embodiments, the base editor is an adenosine base editor (ABE). In some embodiments, an adenosine deaminase is evolved from TadA. In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. In some embodiments, the base editor is fused to an inhibitor of base excision repair (BER). In some embodiments, the inhibitor of base excision repair is a uracil DNA glycosylase inhibitor (UGI). In some embodiments, the inhibitor of base excision repair is an inosine base excision repair inhibitor. Details of base editors are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By way of example, the cytidine base editor CBE as used in the base editing compositions, systems and methods described herein has the following nucleic acid sequence (8877 base pairs), (Addgene, Watertown, MA.; Komor A C, et al., 2017, Sci Adv., 30;3(8):eaao4774. doi: 10.1126/sciadv.aao4774) as provided below. Polynucleotide sequences having at least 95% or greater identity to the BE4 nucleic acid sequence are also encompassed.

(SEQ ID NO: 3)

```
1     atatgccaag tacgccccct attgacgtca atgacggtaa atggcccgcc tggcattatg
61    cccagtacat gaccttatgg gactttccta cttggcagta catctacgta ttagtcatcg
121   ctattaccat ggtgatgcgg ttttggcagt acatcaatgg gcgtggatag cggtttgact
181   cacggggatt tccaagtctc caccccattg acgtcaatgg gagtttgttt tggcaccaaa
241   atcaacggga ctttccaaaa tgtcgtaaca actccgcccc attgacgcaa atgggcggta
301   ggcgtgtacg gtgggaggtc tatataagca gagctggttt agtgaaccgt cagatccgct
361   agagatccgc ggccgctaat acgactcact atagggagag ccgccaccat gagctcagag
421   actggcccag tggctgtgga ccccacattg agacggcgga tcgagcccca tgagtttgag
481   gtattcttcg atccgagaga gctccgcaag gagacctgcc tgctttacga aattaattgg
541   gggggccggc actccatttg gcgacataca tcacagaaca ctaacaagca cgtcgaagtc
601   aacttcatcg agaagttcac gacagaaaga tatttctgtc cgaacacaag gtgcagcatt
661   acctggtttc tcagctggag cccatgcggc gaatgtagta gggccatcac tgaattcctg
721   tcaaggtatc cccacgtcac tctgtttatt tacatcgcaa ggctgtacca ccacgctgac
781   ccccgcaatc gacaaggcct gcgggatttg atctcttcag gtgtgactat ccaaattatg
841   actgagcagg agtcaggata ctgctggaga aactttgtga attatagccc gagtaatgaa
901   gcccactggc ctaggtatcc ccatctgtgg gtacgactgt acgttcttga actgtactgc
961   atcatactgg gcctgcctcc ttgtctcaac attctgagaa ggaagcagcc acagctgaca
1021  ttctttacca tcgctcttca gtcttgtcat taccagcgac tgccccaca cattctctgg
1081  gccaccgggt tgaaatctgg tggttcttct ggtggttcta gcggcagcga gactcccggg
1141  acctcagagt ccgccacacc cgaaagttct ggtggttctt ctggtggttc tgataaaaag
1201  tattctattg gtttagccat cggcactaat tccgttggat gggctgtcat aaccgatgaa
1261  tacaaagtac cttcaaagaa atttaaggtg ttggggaaca cagaccgtca ttcgattaaa
1321  aagaatctta tcggtgccct cctattcgat agtggcgaaa cggcagaggc gactcgcctg
1381  aaacgaaccg ctcggagaag gtatacacgt cgcaagaacc gaatatgtta cttacaagaa
1441  atttttagca atgagatggc caaagttgac gattctttct ttcaccgttt ggaagagtcc
1501  ttccttgtcg aagaggacaa gaaacatgaa cggcacccca tctttggaaa catagtagat
1561  gaggtggcat atcatgaaaa gtacccaacg atttatcacc tcagaaaaaa gctagttgac
1621  tcaactgata aagcggacct gaggttaatc tacttggctc ttgcccatat gataaagttc
1681  cgtgggcact ttctcattga gggtgatcta aatccggaca actcggatgt cgacaaactg
1741  ttcatccagt tagtacaaac ctataatcag ttgtttgaag agaaccctat aaatgcaagt
```

-continued 1801 ggcgtggatg cgaaggctat tcttagcgcc cgcctctcta aatcccgacg gctagaaaac
1861 ctgatcgcac aattacccgg agagaagaaa aatgggttgt tcggtaacct tatagcgctc
1921 tcactaggcc tgacaccaaa ttttaagtcg aacttcgact tagctgaaga tgccaaattg
1981 cagcttagta aggacacgta cgatgacgat ctcgacaatc tactggcaca aattggagat
2041 cagtatgcgg acttattttt ggctgccaaa aaccttagcg atgcaatcct cctatctgac
2101 atactgagag ttaatactga gattaccaag gcgccgttat ccgcttcaat gatcaaaagg
2161 tacgatgaac atcaccaaga cttgacactt ctcaaggccc tagtccgtca gcaactgcct
2221 gagaaatata aggaaatatt ctttgatcag tcgaaaaacg ggtacgcagg ttatattgac
2281 ggcggagcga gtcaagagga attctacaag tttatcaaac ccatattaga gaagatggat
2341 gggacggaag agttgcttgt aaaactcaat cgcgaagatc tactgcgaaa gcagcggact
2401 ttcgacaacg gtagcattcc acatcaaatc cacttaggcg aattgcatgc tatacttaga
2461 aggcaggagg atttttatcc gttcctcaaa gacaatcgtg aaaagattga gaaaatccta
2521 acctttcgca taccttacta tgtgggaccc ctggcccgag ggaactctcg gttcgcatgg
2581 atgacaagaa agtccgaaga aacgattact ccatggaatt ttgaggaagt tgtcgataaa
2641 ggtgcgtcag ctcaatcgtt catcgagagg atgaccaact ttgacaagaa tttaccgaac
2701 gaaaaagtat tgcctaagca cagtttactt tacgagtatt tcacagtgta caatgaactc
2761 acgaaagtta agtatgtcac tgagggcatg cgtaaacccg cctttctaag cggagaacag
2821 aagaaagcaa tagtagatct gttattcaag accaaccgca aagtgacagt taagcaattg
2881 aaagaggact actttaagaa aattgaatgc ttcgattctg tcgagatctc cggggtagaa
2941 gatcgattta atgcgtcact tggtacgtat catgacctcc taaagataat taaagataag
3001 gacttcctgg ataacgaaga gaatgaagat atcttagaag atatagtgtt gactcttacc
3061 ctctttgaag atcgggaaat gattgaggaa agactaaaaa catacgctca cctgttcgac
3121 gataaggtta tgaaacagtt aaagaggcgt cgctatacgg gctggggacg attgtcgcgg
3181 aaacttatca acgggataag agacaagcaa agtggtaaaa ctattctcga ttttctaaag
3241 agcgacggct tcgccaatag gaactttatg cagctgatcc atgatgactc tttaaccttc
3301 aaagaggata tacaaaaggc acaggtttcc ggacaagggg actcattgca cgaacatatt
3361 gcgaatcttg ctggttcgcc agccatcaaa aagggcatac tccagacagt caaagtagtg
3421 gatgagctag ttaaggtcat gggacgtcac aaaccggaaa acattgtaat cgagatggca
3481 cgcgaaaatc aaacgactca gaaggggcaa aaaaacagtc gagagcggat gaagagaata
3541 gaagagggta ttaaagaact gggcagccag atcttaaagg agcatcctgt ggaaaatacc
3601 caattgcaga acgagaaact ttacctctat tacctacaaa atggaaggga catgtatgtt
3661 gatcaggaac tggacataaa ccgtttatct gattacgacg tcgatcacat tgtaccccaa
3721 tcctttttga aggacgattc aatcgacaat aaagtgctta cacgctcgga taagaaccga
3781 gggaaaagtg acaatgttcc aagcgaggaa gtcgtaaaga aaatgaagaa ctattggcgg
3841 cagctcctaa atgcgaaact gataacgcaa agaaagttcg ataacttaac taaagctgag
3901 aggggtggct tgtctgaact tgacaaggcc ggatttatta aacgtcagct cgtggaaacc
3961 cgccaaatca caaagcatgt tgcacagata ctagattccc gaatgaatac gaaatacgac
4021 gagaacgata agctgattcg ggaagtcaaa gtaatcactt taaagtcaaa attggtgtcg
4081 gacttcagaa aggattttca attctataaa gttagggaga taaataacta ccaccatgcg
4141 cacgacgctt atcttaatgc cgtcgtaggg accgcactca ttaagaaata cccgaagcta
4201 gaaagtgagt ttgtgtatgg tgattacaaa gtttatgacg tccgtaagat gatcgcgaaa -continued 4261 agcgaacagg agataggcaa ggctacagcc aaatacttct tttattctaa cattatgaat 4321 ttctttaaga cggaaatcac tctggcaaac ggagagatac gcaaacgacc tttaattgaa 4381 accaatgggg agacaggtga aatcgtatgg gataagggcc gggacttcgc gacggtgaga 4441 aaagttttgt ccatgcccca agtcaacata gtaaagaaaa ctgaggtgca gaccggaggg 4501 ttttcaaagg aatcgattct tccaaaaagg aatagtgata agctcatcgc tcgtaaaaag 4561 gactgggacc cgaaaaagta cggtggcttc gatagcccta cagttgccta ttctgtccta 4621 gtagtggcaa aagttgagaa gggaaaatcc aagaaactga agtcagtcaa agaattattg 4681 gggataacga ttatggagcg ctcgtctttt gaaaagaacc ccatcgactt ccttgaggcg 4741 aaaggttaca aggaagtaaa aaaggatctc ataattaaac taccaaagta tagtctgttt 4801 gagttagaaa atggccgaaa acggatgttg gctagcgccg gagagcttca aaaggggaac 4861 gaactcgcac taccgtctaa atacgtgaat ttcctgtatt tagcgtccca ttacgagaag 4921 ttgaaaggtt cacctgaaga taacgaacag aagcaacttt ttgttgagca gcacaaacat 4981 tatctcgacg aaatcataga gcaaatttcg gaattcagta agagagtcat cctagctgat 5041 gccaatctgg acaaagtatt aagcgcatac aacaagcaca gggataaacc catacgtgag 5101 caggcggaaa atattatcca tttgtttact cttaccaacc tcggcgctcc agccgcattc 5161 aagtattttg acacaacgat agatcgcaaa cgatacactt ctaccaagga ggtgctagac 5221 gcgacactga ttcaccaatc catcacggga ttatatgaaa ctcggataga tttgtcacag 5281 cttgggggtg actctggtgg ttctggagga tctggtggtt ctactaatct gtcagatatt 5341 attgaaaagg agaccggtaa gcaactggtt atccaggaat ccatcctcat gctcccagag 5401 gaggtggaag aagtcattgg gaacaagccg gaaagcgata tactcgtgca caccgcctac 5461 gacgagagca ccgacgagaa tgtcatgctt ctgactagcg acgcccctga atacaagcct 5521 tgggctctgg tcatacagga tagcaacggt gagaacaaga ttaagatgct ctctggtggt 5581 tctggaggat ctggtggttc tactaatctg tcagatatta ttgaaaagga gaccggtaag 5641 caactggtta tccaggaatc catcctcatg ctcccagagg aggtggaaga agtcattggg 5701 aacaagccgg aaagcgatat actcgtgcac accgcctacg acgagagcac cgacgagaat 5761 gtcatgcttc tgactagcga cgcccctgaa tacaagcctt gggctctggt catacaggat 5821 agcaacggtg agaacaagat taagatgctc tctggtggtt ctcccaagaa gaagaggaaa 5881 gtctaaccgg tcatcatcac catcaccatt gagtttaaac ccgctgatca gcctcgactg 5941 tgccttctag ttgccagcca tctgttgttt gcccctcccc cgtgccttcc ttgaccctgg 6001 aaggtgccac tcccactgtc ctttcctaat aaaatgagga aattgcatcg cattgtctga 6061 gtaggtgtca ttctattctg gggggtgggg tggggcagga cagcaagggg gaggattggg 6121 aagacaatag caggcatgct ggggatgcgg tgggctctat ggcttctgag gcggaaagaa 6181 ccagctgggg ctcgataccg tcgacctcta gctagagctt ggcgtaatca tggtcatagc 6241 tgtttcctgt gtgaaattgt tatccgctca caattccaca caacatacga gccggaagca 6301 taaagtgtaa agcctagggt gcctaatgag tgagctaact cacattaatt gcgttgcgct 6361 cactgcccgc tttccagtcg ggaaacctgt cgtgccagct gcattaatga atcggccaac 6421 gcgcggggag aggcggtttg cgtattgggc gctcttccgc ttcctcgctc actgactcgc 6481 tgcgctcggt cgttcggctg cggcgagcgg tatcagctca ctcaaaggcg gtaatacggt 6541 tatccacaga atcaggggat aacgcaggaa agaacatgtg agcaaaaggc cagcaaaagg 6601 ccaggaaccg taaaaaggcc gcgttgctgg cgtttttcca taggctccgc ccccctgacg -continued 6661 agcatcacaa aaatcgacgc tcaagtcaga ggtggcgaaa cccgacagga ctataaagat
6721 accaggcgtt tccccctgga agctccctcg tgcgctctcc tgttccgacc ctgccgctta
6781 ccggatacct gtccgccttt ctcccttcgg gaagcgtggc gctttctcat agctcacgct
6841 gtaggtatct cagttcggtg taggtcgttc gctccaagct gggctgtgtg cacgaacccc
6901 ccgttcagcc cgaccgctgc gccttatccg gtaactatcg tcttgagtcc aacccggtaa
6961 gacacgactt atcgccactg gcagcagcca ctggtaacag gattagcaga gcgaggtatg
7021 taggcggtgc tacagagttc ttgaagtggt ggcctaacta cggctacact agaagaacag
7081 tatttggtat ctgcgctctg ctgaagccag ttaccttcgg aaaaagagtt ggtagctctt
7141 gatccggcaa acaaaccacc gctggtagcg gtggtttttt tgtttgcaag cagcagatta
7201 cgcgcagaaa aaaaggatct caagaagatc ctttgatctt ttctacgggg tctgacgctc
7261 agtggaacga aaactcacgt taagggattt tggtcatgag attatcaaaa aggatcttca
7321 cctagatcct tttaaattaa aaatgaagtt ttaaatcaat ctaaagtata tatgagtaaa
7381 cttggtctga cagttaccaa tgcttaatca gtgaggcacc tatctcagcg atctgtctat
7441 ttcgttcatc catagttgcc tgactccccg tcgtgtagat aactacgata cgggagggct
7501 taccatctgg ccccagtgct gcaatgatac cgcgagaccc acgctcaccg gctccagatt
7561 tatcagcaat aaaccagcca gccggaaggg ccgagcgcag aagtggtcct gcaactttat
7621 ccgcctccat ccagtctatt aattgttgcc gggaagctag agtaagtagt tcgccagtta
7681 atagtttgcg caacgttgtt gccattgcta caggcatcgt ggtgtcacgc tcgtcgtttg
7741 gtatggcttc attcagctcc ggttcccaac gatcaaggcg agttacatga tcccccatgt
7801 tgtgcaaaaa agcggttagc tccttcggtc ctccgatcgt tgtcagaagt aagttggccg
7861 cagtgttatc actcatggtt atggcagcac tgcataattc tcttactgtc atgccatccg
7921 taagatgctt ttctgtgact ggtgagtact caaccaagtc attctgagaa tagtgtatgc
7981 ggcgaccgag ttgctcttgc ccggcgtcaa tacgggataa taccgcgcca catagcagaa
8041 ctttaaaagt gctcatcatt ggaaaacgtt cttcggggcg aaaactctca aggatcttac
8101 cgctgttgag atccagttcg atgtaaccca ctcgtgcacc caactgatct tcagcatctt
8161 ttactttcac cagcgtttct gggtgagcaa aaacaggaag gcaaaatgcc gcaaaaaagg
8221 gaataagggc gacacggaaa tgttgaatac tcatactctt cctttttcaa tattattgaa
8281 gcatttatca gggttattgt ctcatgagcg gatacatatt tgaatgtatt tagaaaaata
8341 aacaaatagg ggttccgcgc acatttcccc gaaaagtgcc acctgacgtc gacggatcgg
8401 gagatcgatc tcccgatccc ctagggtcga ctctcagtac aatctgctct gatgccgcat
8461 agttaagcca gtatctgctc cctgcttgtg tgttggaggt cgctgagtag tgcgcgagca
8521 aaatttaagc tacaacaagg caaggcttga ccgacaattg catgaagaat ctgcttaggg
8581 ttaggcgttt tgcgctgctt cgcgatgtac gggccagata tacgcgttga cattgattat
8641 tgactagtta ttaatagtaa tcaattacgg ggtcattagt tcatagccca tatatggagt
8701 tccgcgttac ataacttacg gtaaatggcc cgcctggctg accgcccaac gacccccgcc
8761 cattgacgtc aataatgacg tatgttccca tagtaacgcc aatagggact ttccattgac
8821 gtcaatgggt ggagtattta cggtaaactg cccacttggc agtacatcaa gtgtatc BE4 amino acid sequence:

(SEQ ID NO: 4)

MSSETGPVAVDPTLRRRIEPHEFEVFFDPRELRKETCLLYEINWGGRH

SIWRHTSQNTNKHVEVNFIEKFTTERYFCPNTRCSITWFLSWSPCGEC

SRAITEFLSRYPHVTLFIYIARLYHHADPRNRQGLRDLISSGVTIQIM

TEQESGYCWRNFVNYSPSNEAHWPRYPHLWVRLYVLELYCIILGLPPC

LNILRRKQPQLTFFTIALQSCHYQRLPPHILWATGLKSGGSSGGSSGS

ETPGTSESATPESSGGSSGGSDKKYSIGLAIGTNSVGWAVITDEYKVP

SKKFKVLGNTDRHSIKKNLIGALLFDSGETAEATRLKRTARRRYTRRK

NRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEG

DLNPDNSDVDKLFIQLVQTYNQLFEENPINASGVDAKAILSARLSKSR

RLENLIAQLPGEKKNGLFGNLIALSLGLTPNEKSNEDLAEDAKLQLSK

DTYDDDLDNLLAQIGDQYADLFLAAKNLSDAILLSDILRVNTEITKAP

LSASMIKRYDEHHQDLTLLKALVRQQLPEKYKEIFFDQSKNGYAGYID

GGASQEEFYKFIKPILEKMDGTEELLVKLNREDLLRKQRTFDNGSIPH

QIHLGELHAILRRQEDFYPFLKDNREKIEKILTFRIPYYVGPLARGNS

RFAWMTRKSEETITPWNFEEVVDKGASAQSFIERMTNEDKNLPNEKVL

PKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDK

DFLDNEENEDILEDIVLTLTLFEDREMIEERLKTYAHLFDDKVMKQLK

RRRYTGWGRLSRKLINGIRDKQSGKTILDFLKSDGFANRNFMQLIHDD

SLTFKEDIQKAQVSGQGDSLHEHIANLAGSPAIKKGILQTVKVVDELV

-continued

KVMGRHKPENIVIEMARENQTTQKGQKNSRERMKRIEEGIKELGSQIL

KEHPVENTQLQNEKLYLYYLQNGRDMYVDQELDINRLSDYDVDHIVPQ

SFLKDDSIDNKVLTRSDKNRGKSDNVPSEEVVKKMKNYWRQLLNAKLI

TQRKFDNLTKAERGGLSELDKAGFIKRQLVETRQITKHVAQILDSRMN

TKYDENDKLIREVKVITLKSKLVSDFRKDFQFYKVREINNYHHAHDAY

LNAVVGTALIKKYPKLESEFVYGDYKVYDVRKMIAKSEQEIGKATAKY

FFYSNIMNFFKTEITLANGEIRKRPLIETNGETGEIVWDKGRDFATVR

KVLSMPQVNIVKKTEVQTGGFSKESILPKRNSDKLIARKKDWDPKKYG

GFDSPTVAYSVLVVAKVEKGKSKKLKSVKELLGITIMERSSFEKNPID

FLEAKGYKEVKKDLIIKLPKYSLFELENGRKRMLASAGELQKGNELAL

PSKYVNFLYLASHYEKLKGSPEDNEQKQLFVEQHKHYLDEIIEQISEF

SKRVILADANLDKVLSAYNKHRDKPIREQAENIIHLFTLTNLGAPAAF

KYFDTTIDRKRYTSTKEVLDATLIHQSITGLYETRIDLSQLGGDSGGS

GGSGGSTNLSDIIEKETGKQLVIQESILMLPEEVEEVIGNKPESDILV

HTAYDESTDENVMLLTSDAPEYKPWALVIQDSNGENKIKMLSGGSGGS

GGSTNLSDIIEKETGKQLVIQESILMLPEEVEEVIGNKPESDILVHTA

YDESTDENVMLLTSDAPEYKPWALVIQDSNGENKIKMLSGGSPKKKRK

By way of example, the adenine base editor ABE as used in the base editing compositions, systems and methods described herein has the following nucleic acid sequence (8877 base pairs), (Addgene, Watertown, MA.; Gaudelli N M, et al., Nature. 2017 Nov. 23; 551(7681):464-471. doi: 10.1038/nature24644; Koblan L W, et al., Nat Biotechnol. 2018 October;36(9):843-846. doi: 10.1038/nbt.4172.) as provided below. Polynucleotide sequences having at least 95% or greater identity to the ABE nucleic acid sequence are also encompassed.

(SEQ ID NO: 5)

ATATGCCAAGTACGCCCCCTATTGACGTCAATGACGGTAAATGGCCCGCCTGGCATTATGCCCAGTACAT

GACCTTATGGGACTTTCCTACTTGGCAGTACATCTACGTATTAGTCATCGCTATTACCATGGTGATGCGG

TTTTGGCAGTACATCAATGGGCGTGGATAGCGGTTTGACTCACGGGGATTTCCAAGTCTCCACCCCATTG

ACGTCAATGGGAGTTTGTTTTGGCACCAAAATCAACGGGACTTTCCAAAATGTCGTAACAACTCCGCCCC

ATTGACGCAAATGGGCGGTAGGCGTGTACGGTGGGAGGTCTATATAAGCAGAGCTGGTTTAGTGAACCGT

CAGATCCGCTAGAGATCCGCGGCCGCTAATACGACTCACTATAGGGAGAGCCGCCACCATGAAACGGACA

GCCGACGGAAGCGAGTTCGAGTCACCAAAGAAGAAGCGGAAAGTCTCTGAAGTCGAGTTTAGCCACGAGT

ATTGGATGAGGCACGCACTGACCCTGGCAAAGCGAGCATGGGATGAAAGAGAAGTCCCCGTGGGCGCCGT

GCTGGTGCACAACAATAGAGTGATCGGAGAGGGATGGAACAGGCCAATCGGCCGCCACGACCCTACCGCA

CACGCAGAGATCATGGCACTGAGGCAGGGAGGCCTGGTCATGCAGAATTACCGCCTGATCGATGCCACCC

TGTATGTGACACTGGAGCCATGCGTGATGTGCGCAGGAGCAATGATCCACAGCAGGATCGGAAGAGTGGT

GTTCGGAGCACGGGACGCCAAGACCGGCGCAGCAGGCTCCCTGATGGATGTGCTGCACCACCCCGGCATG

AACCACCGGGTGGAGATCACAGAGGGAATCCTGGCAGACGAGTGCGCCGCCCTGCTGAGCGATTTCTTTA

GAATGCGGAGACAGGAGATCAAGGCCCAGAAGAAGGCACAGAGCTCCACCGACTCTGGAGGATCTAGCGG

AGGATCCTCTGGAAGCGAGACACCAGGCACAAGCGAGTCCGCCACACCAGAGAGCTCCGGCGGCTCCTCC

GGAGGATCCTCTGAGGTGGAGTTTTCCCACGAGTACTGGATGAGACATGCCCTGACCCTGGCCAAGAGGG

-continued

CACGCGATGAGAGGGAGGTGCCTGTGGGAGCCGTGCTGGTGCTGAACAATAGAGTGATCGGCGAGGGCTG

GAACAGAGCCATCGGCCTGCACGACCCAACAGCCCATGCCGAAATTATGGCCCTGAGACAGGGCGGCCTG

GTCATGCAGAACTACAGACTGATTGACGCCACCCTGTACGTGACATTCGAGCCTTGCGTGATGTGCGCCG

GCGCCATGATCCACTCTAGGATCGGCCGCGTGGTGTTTGGCGTGAGGAACGCAAAAACCGGCGCCGCAGG

CTCCCTGATGGACGTGCTGCACTACCCCGGCATGAATCACCGCGTCGAAATTACCGAGGGAATCCTGGCA

GATGAATGTGCCGCCCTGCTGTGCTATTTCTTTCGGATGCCTAGACAGGTGTTCAATGCTCAGAAGAAGG

CCCAGAGCTCCACCGACTCCGGAGGATCTAGCGGAGGCTCCTCTGGCTCTGAGACACCTGGCACAAGCGA

GAGCGCAACACCTGAAAGCAGCGGGGGCAGCAGCGGGGGGTCAGACAAGAAGTACAGCATCGGCCTGGCC

ATCGGCACCAACTCTGTGGGCTGGGCCGTGATCACCGACGAGTACAAGGTGCCCAGCAAGAAATTCAAGG

TGCTGGGCAACACCGACCGGCACAGCATCAAGAAGAACCTGATCGGAGCCCTGCTGTTCGACAGCGGCGA

AACAGCCGAGGCCACCCGGCTGAAGAGAACCGCCAGAAGAAGATACACCAGACGGAAGAACCGGATCTGC

TATCTGCAAGAGATCTTCAGCAACGAGATGGCCAAGGTGGACGACAGCTTCTTCCACAGACTGGAAGAGT

CCTTCCTGGTGGAAGAGGATAAGAAGCACGAGCGGCACCCCATCTTCGGCAACATCGTGGACGAGGTGGC

CTACCACGAGAAGTACCCCACCATCTACCACCTGAGAAAGAAACTGGTGGACAGCACCGACAAGGCCGAC

CTGCGGCTGATCTATCTGGCCCTGGCCCACATGATCAAGTTCCGGGGCCACTTCCTGATCGAGGGCGACC

TGAACCCCGACAACAGCGACGTGGACAAGCTGTTCATCCAGCTGGTGCAGACCTACAACCAGCTGTTCGA

GGAAAACCCCATCAACGCCAGCGGCGTGGACGCCAAGGCCATCCTGTCTGCCAGACTGAGCAAGAGCAGA

CGGCTGGAAAATCTGATCGCCCAGCTGCCCGGCGAGAAGAAGAATGGCCTGTTCGGAAACCTGATTGCCC

TGAGCCTGGGCCTGACCCCCAACTTCAAGAGCAACTTCGACCTGGCCGAGGATGCCAAACTGCAGCTGAG

CAAGGACACCTACGACGACGACCTGGACAACCTGCTGGCCCAGATCGGCGACCAGTACGCCGACCTGTTT

CTGGCCGCCAAGAACCTGTCCGACGCCATCCTGCTGAGCGACATCCTGAGAGTGAACACCGAGATCACCA

AGGCCCCCCTGAGCGCCTCTATGATCAAGAGATACGACGAGCACCACCAGGACCTGACCCTGCTGAAAGC

TCTCGTGCGGCAGCAGCTGCCTGAGAAGTACAAAGAGATTTTCTTCGACCAGAGCAAGAACGGCTACGCC

GGCTACATTGACGGCGGAGCCAGCCAGGAAGAGTTCTACAAGTTCATCAAGCCCATCCTGGAAAAGATGG

ACGGCACCGAGGAACTGCTCGTGAAGCTGAACAGAGAGGACCTGCTGCGGAAGCAGCGGACCTTCGACAA

CGGCAGCATCCCCCACCAGATCCACCTGGGAGAGCTGCACGCCATTCTGCGGCGGCAGGAAGATTTTTAC

CCATTCCTGAAGGACAACCGGGAAAAGATCGAGAAGATCCTGACCTTCCGCATCCCCTACTACGTGGGCC

CTCTGGCCAGGGGAAACAGCAGATTCGCCTGGATGACCAGAAAGAGCGAGGAAACCATCACCCCCTGGAA

CTTCGAGGAAGTGGTGGACAAGGGCGCTTCCGCCCAGAGCTTCATCGAGCGGATGACCAACTTCGATAAG

AACCTGCCCAACGAGAAGGTGCTGCCCAAGCACAGCCTGCTGTACGAGTACTTCACCGTGTATAACGAGC

TGACCAAAGTGAAATACGTGACCGAGGGAATGAGAAAGCCCGCCTTCCTGAGCGGCGAGCAGAAAAAGGC

CATCGTGGACCTGCTGTTCAAGACCAACCGGAAAGTGACCGTGAAGCAGCTGAAAGAGGACTACTTCAAG

AAAATCGAGTGCTTCGACTCCGTGGAAATCTCCGGCGTGGAAGATCGGTTCAACGCCTCCCTGGGCACAT

ACCACGATCTGCTGAAAATTATCAAGGACAAGGACTTCCTGGACAATGAGGAAAACGAGGACATTCTGGA

AGATATCGTGCTGACCCTGACACTGTTTGAGGACAGAGAGATGATCGAGGAACGGCTGAAAACCTATGCC

CACCTGTTCGACGACAAAGTGATGAAGCAGCTGAAGCGGCGGAGATACACCGGCTGGGGCAGGCTGAGCC

GGAAGCTGATCAACGGCATCCGGGACAAGCAGTCCGGCAAGACAATCCTGGATTTCCTGAAGTCCGACGG

CTTCGCCAACAGAAACTTCATGCAGCTGATCCACGACGACAGCCTGACCTTTAAAGAGGACATCCAGAAA

GCCCAGGTGTCCGGCCAGGGCGATAGCCTGCACGAGCACATTGCCAATCTGGCCGGCAGCCCCGCCATTA

AGAAGGGCATCCTGCAGACAGTGAAGGTGGTGGACGAGCTCGTGAAAGTGATGGGCCGGCACAAGCCCGA

-continued

GAACATCGTGATCGAAATGGCCAGAGAGAACCAGACCACCCAGAAGGGACAGAAGAACAGCCGCGAGAGA

ATGAAGCGGATCGAAGAGGGCATCAAAGAGCTGGGCAGCCAGATCCTGAAAGAACACCCCGTGGAAAACA

CCCAGCTGCAGAACGAGAAGCTGTACCTGTACTACCTGCAGAATGGGCGGGATATGTACGTGGACCAGGA

ACTGGACATCAACCGGCTGTCCGACTACGATGTGGACCATATCGTGCCTCAGAGCTTTCTGAAGGACGAC

TCCATCGACAACAAGGTGCTGACCAGAAGCGACAAGAACCGGGGCAAGAGCGACAACGTGCCCTCCGAAG

AGGTCGTGAAGAAGATGAAGAACTACTGGCGGCAGCTGCTGAACGCCAAGCTGATTACCCAGAGAAAGTT

CGACAATCTGACCAAGGCCGAGAGAGGCGGCCTGAGCGAACTGGATAAGGCCGGCTTCATCAAGAGACAG

CTGGTGGAAACCCGGCAGATCACAAAGCACGTGGCACAGATCCTGGACTCCCGGATGAACACTAAGTACG

ACGAGAATGACAAGCTGATCCGGGAAGTGAAAGTGATCACCCTGAAGTCCAAGCTGGTGTCCGATTTCCG

GAAGGATTTCCAGTTTTACAAAGTGCGCGAGATCAACAACTACCACCACGCCCACGACGCCTACCTGAAC

GCCGTCGTGGGAACCGCCCTGATCAAAAAGTACCCTAAGCTGGAAAGCGAGTTCGTGTACGGCGACTACA

AGGTGTACGACGTGCGGAAGATGATCGCCAAGAGCGAGCAGGAAATCGGCAAGGCTACCGCCAAGTACTT

CTTCTACAGCAACATCATGAACTTTTTCAAGACCGAGATTACCCTGGCCAACGGCGAGATCCGGAAGCGG

CCTCTGATCGAGACAAACGGCGAAACCGGGGAGATCGTGTGGGATAAGGGCCGGGATTTTGCCACCGTGC

GGAAAGTGCTGAGCATGCCCCAAGTGAATATCGTGAAAAAGACCGAGGTGCAGACAGGCGGCTTCAGCAA

AGAGTCTATCCTGCCCAAGAGGAACAGCGATAAGCTGATCGCCAGAAAGAAGGACTGGGACCCTAAGAAG

TACGGCGGCTTCGACAGCCCCACCGTGGCCTATTCTGTGCTGGTGGTGGCCAAAGTGGAAAAGGGCAAGT

CCAAGAAACTGAAGAGTGTGAAAGAGCTGCTGGGGATCACCATCATGGAAAGAAGCAGCTTCGAGAAGAA

TCCCATCGACTTTCTGGAAGCCAAGGGCTACAAAGAAGTGAAAAAGGACCTGATCATCAAGCTGCCTAAG

TACTCCCTGTTCGAGCTGGAAAACGGCCGGAAGAGAATGCTGGCCTCTGCCGGCGAACTGCAGAAGGGAA

ACGAACTGGCCCTGCCCTCCAAATATGTGAACTTCCTGTACCTGGCCAGCCACTATGAGAAGCTGAAGGG

CTCCCCCGAGGATAATGAGCAGAAACAGCTGTTTGTGGAACAGCACAAGCACTACCTGGACGAGATCATC

GAGCAGATCAGCGAGTTCTCCAAGAGAGTGATCCTGGCCGACGCTAATCTGGACAAAGTGCTGTCCGCCT

ACAACAAGCACCGGGATAAGCCCATCAGAGAGCAGGCCGAGAATATCATCCACCTGTTTACCCTGACCAA

TCTGGGAGCCCCTGCCGCCTTCAAGTACTTTGACACCACCATCGACCGGAAGAGGTACACCAGCACCAAA

GAGGTGCTGGACGCCACCCTGATCCACCAGAGCATCACCGGCCTGTACGAGACACGGATCGACCTGTCTC

AGCTGGGAGGTGACTCTGGCGGCTCAAAAAGAACCGCCGACGGCAGCGAATTCGAGCCCAAGAAGAAGAG

GAAAGTCTAACCGGTCATCATCACCATCACCATTGAGTTTAAACCCGCTGATCAGCCTCGACTGTGCCTT

CTAGTTGCCAGCCATCTGTTGTTTGCCCCTCCCCCGTGCCTTCCTTGACCCTGGAAGGTGCCACTCCCAC

TGTCCTTTCCTAATAAAATGAGGAAATTGCATCGCATTGTCTGAGTAGGTGTCATTCTATTCTGGGGGGT

GGGGTGGGGCAGGACAGCAAGGGGGAGGATTGGGAAGACAATAGCAGGCATGCTGGGGATGCGGTGGGCT

CTATGGCTTCTGAGGCGGAAAGAACCAGCTGGGGCTCGATACCGTCGACCTCTAGCTAGAGCTTGGCGTA

ATCATGGTCATAGCTGTTTCCTGTGTGAAATTGTTATCCGCTCACAATTCCACACAACATACGAGCCGGA

AGCATAAAGTGTAAAGCCTAGGGTGCCTAATGAGTGAGCTAACTCACATTAATTGCGTTGCGCTCACTGC

CCGCTTTCCAGTCGGGAAACCTGTCGTGCCAGCTGCATTAATGAATCGGCCAACGCGCGGGGAGAGGCGG

TTTGCGTATTGGGCGCTCTTCCGCTTCCTCGCTCACTGACTCGCTGCGCTCGGTCGTTCGGCTGCGGCGA

GCGGTATCAGCTCACTCAAAGGCGGTAATACGGTTATCCACAGAATCAGGGGATAACGCAGGAAAGAACA

TGTGAGCAAAAGGCCAGCAAAAGGCCAGGAACCGTAAAAAGGCCGCGTTGCTGGCGTTTTTCCATAGGCT

CCGCCCCCCTGACGAGCATCACAAAAATCGACGCTCAAGTCAGAGGTGGCGAAACCCGACAGGACTATAA

AGATACCAGGCGTTTCCCCCTGGAAGCTCCCTCGTGCGCTCTCCTGTTCCGACCCTGCCGCTTACCGGAT

ACCTGTCCGCCTTTCTCCCTTCGGGAAGCGTGGCGCTTTCTCATAGCTCACGCTGTAGGTATCTCAGTTC

-continued

```
GGTGTAGGTCGTTCGCTCCAAGCTGGGCTGTGTGCACGAACCCCCCGTTCAGCCCGACCGCTGCGCCTTA

TCCGGTAACTATCGTCTTGAGTCCAACCCGGTAAGACACGACTTATCGCCACTGGCAGCAGCCACTGGTA

ACAGGATTAGCAGAGCGAGGTATGTAGGCGGTGCTACAGAGTTCTTGAAGTGGTGGCCTAACTACGGCTA

CACTAGAAGAACAGTATTTGGTATCTGCGCTCTGCTGAAGCCAGTTACCTTCGGAAAAAGAGTTGGTAGC

TCTTGATCCGGCAAACAAACCACCGCTGGTAGCGGTGGTTTTTTTGTTTGCAAGCAGCAGATTACGCGCA

GAAAAAAAGGATCTCAAGAAGATCCTTTGATCTTTTCTACGGGGTCTGACACTCAGTGGAACGAAAACTC

ACGTTAAGGGATTTTGGTCATGAGATTATCAAAAAGGATCTTCACCTAGATCCTTTTAAATTAAAAATGA

AGTTTTAAATCAATCTAAAGTATATATGAGTAAACTTGGTCTGACAGTTACCAATGCTTAATCAGTGAGG

CACCTATCTCAGCGATCTGTCTATTTCGTTCATCCATAGTTGCCTGACTCCCCGTCGTGTAGATAACTAC

GATACGGGAGGGCTTACCATCTGGCCCCAGTGCTGCAATGATACCGCGAGACCCACGCTCACCGGCTCCA

GATTTATCAGCAATAAACCAGCCAGCCGGAAGGGCCGAGCGCAGAAGTGGTCCTGCAACTTTATCCGCCT

CCATCCAGTCTATTAATTGTTGCCGGGAAGCTAGAGTAAGTAGTTCGCCAGTTAATAGTTTGCGCAACGT

TGTTGCCATTGCTACAGGCATCGTGGTGTCACGCTCGTCGTTTGGTATGGCTTCATTCAGCTCCGGTTCC

CAACGATCAAGGCGAGTTACATGATCCCCCATGTTGTGCAAAAAAGCGGTTAGCTCCTTCGGTCCTCCGA

TCGTTGTCAGAAGTAAGTTGGCCGCAGTGTTATCACTCATGGTTATGGCAGCACTGCATAATTCTCTTAC

TGTCATGCCATCCGTAAGATGCTTTTCTGTGACTGGTGAGTACTCAACCAAGTCATTCTGAGAATAGTGT

ATGCGGCGACCGAGTTGCTCTTGCCCGGCGTCAATACGGGATAATACCGCGCCACATAGCAGAACTTTAA

AAGTGCTCATCATTGGAAAACGTTCTTCGGGGCGAAAACTCTCAAGGATCTTACCGCTGTTGAGATCCAG

TTCGATGTAACCCACTCGTGCACCCAACTGATCTTCAGCATCTTTTACTTTCACCAGCGTTTCTGGGTGA

GCAAAAACAGGAAGGCAAAATGCCGCAAAAAAGGGAATAAGGGCGACACGGAAATGTTGAATACTCATAC

TCTTCCTTTTTCAATATTATTGAAGCATTTATCAGGGTTATTGTCTCATGAGCGGATACATATTTGAATG

TATTTAGAAAAATAAACAAATAGGGGTTCCGCGCACATTTCCCCGAAAAGTGCCACCTGACGTCGACGGA

TCGGGAGATCGATCTCCCGATCCCCTAGGGTCGACTCTCAGTACAATCTGCTCTGATGCCGCATAGTTAA

GCCAGTATCTGCTCCCTGCTTGTGTGTTGGAGGTCGCTGAGTAGTGCGCGAGCAAAATTTAAGCTACAAC

AAGGCAAGGCTTGACCGACAATTGCATGAAGAATCTGCTTAGGGTTAGGCGTTTTGCGCTGCTTCGCGAT

GTACGGGCCAGATATACGCGTTGACATTGATTATTGACTAGTTATTAATAGTAATCAATTACGGGGTCAT

TAGTTCATAGCCCATATATGGAGTTCCGCGTTACATAACTTACGGTAAATGGCCCGCCTGGCTGACCGCC

CAACGACCCCCGCCCATTGACGTCAATAATGACGTATGTTCCCATAGTAACGCCAATAGGGACTTTCCAT

TGACGTCAATGGGTGGAGTATTTACGGTAAACTGCCCACTTGGCAGTACATCAAGTGTATC
```

By "base editing activity" is meant acting to chemically alter a base within a polynucleotide. In one embodiment, a first base is converted to a second base. In one embodiment, the base editing activity is cytidine deaminase activity, e.g., converting target C•G to T•A. In another embodiment, the base editing activity is adenosine or adenine deaminase activity, e.g., converting A•T to G•C.

The term "base editor system" refers to a system for editing a nucleobase of a target nucleotide sequence. In various embodiments, the base editor (BE) system comprises (1) a polynucleotide programmable nucleotide binding domain and a deaminase domain for deaminating said nucleobase; and (2) a guide polynucleotide (e.g., guide RNA) in conjunction with the polynucleotide programmable nucleotide binding domain. In some embodiments, the base editor system comprises (1) a base editor (BE) comprising a polynucleotide programmable DNA binding domain and a deaminase domain for deaminating said nucleobase; and (2) a guide RNA in conjunction with the polynucleotide programmable DNA binding domain. In some embodiments, the polynucleotide programmable nucleotide binding domain is a polynucleotide programmable DNA binding domain. In some embodiments, the base editor is a cytidine base editor (CBE). In some embodiments, the base editor is an adenine or adenosine base editor (ABE).

In some embodiments, a nucleobase editor system may comprise more than one base editing component. For example, a nucleobase editor system may include more than one deaminase. In some embodiments, a nuclease base editor system may include one or more cytidine deaminase and/or one or more adenosine deaminases. In some embodiments, a single guide polynucleotide may be utilized to target different deaminases to a target nucleic acid sequence. In some embodiments, a single pair of guide polynucleotides may be utilized to target different deaminases to a target nucleic acid sequence.

The nucleobase component and the polynucleotide programmable nucleotide binding component of a base editor system may be associated with each other covalently or non-covalently. For example, in some embodiments, a deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g. the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g. the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Coin coat protein domain, a sterile alpha motif, a telomerase Ku binding motif and Ku protein, a telomerase Sm7 binding motif and Sm7 protein, or a RNA recognition motif.

The term "Cas9" or "Cas9 domain" refers to an RNA guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casnl nuclease or a CRISPR (clustered regularly interspaced short palindromic repeat) associated nuclease. An exemplary Cas9, is *Streptococcus pyogenes* Cas9, the amino acid sequence of which is provided below:

```
                                   (SEQ ID NO: 6)
MDKKYSIGLDIGTNSVGWAVITDDYKVPSKKFKVLGNTDRHSIKKNLIG
ALLFGSGETAEATRLKRTARRRYTRRKNRICYLQEIFSNEMAKVDDSFF
HRLEESFLVEEDKKHERHPIFGNIVDEVAYHEKYPTIYHLRKKLADSTD
KADLRLIYLALAHMIKFRGHFLIEGDLNPDNSDVDKLFIQLVQIYNQLF
EENPINASRVDAKAILSARLSKSRRLENLIAQLPGEKRNGLFGNLIALS
LGLTPNFKSNFDLAEDAKLQLSKDTYDDDLDNLLAQIGDQYADLFLAAK
NLSDAILLSDILRVNSEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGAYHDLLKIIKDKDFLDNEENEDILEDIVLTLTLFEDRGMIEERLK
TYAHLFDDKVMKQLKRRRYTGWGRLSRKLINGIRDKQSGKTILDFLKSD
GFANRNFMQLIHDDSLTFKEDIQKAQVSGQGHSLHEQIANLAGSPAIKK
GILQTVKIVDELVKVMGHKPENIVIEMARENQTTQKGQKNSRERMKRIE
EGIKELGSQILKEHPVENTQLQNEKLYLYYLQNGRDMYVDQELDINRLS
DYDVDHIVPQSFIKDDSIDNKVLTRSDKNRGKSDNVPSEEVVKKMKNYW
RQLLNAKLITQRKFDNLTKAERGGLSELDKAGFIKRQLVETRQITKHVA
QILDSRMNTKYDENDKLIREVKVITLKSKLVSDFRKDFQFYKVREINNY
HHAHDAYLNAVVGTALIKKYPKLESEFVYGDYKVYDVRKMIAKSEQEIG
KATAKYFFYSNIMNFFKTEITLANGEIRKRPLIETNGETGEIVWDKGRD
FATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKN
PIDFLEAKGYKEVKKDLIIKLPKYSLFELENGRKRMLASAGELQKGNEL
ALPSKYVNFLYLASHYEKLKGSPEDNEQKQLFVEQHKHYLDEIIEQISE
FSKRVILADANLDKVLSAYNKHRDKPIREQAENIIHLFTLTNLGAPAAF
KYFDTTIDRKRYTSTKEVLDATLIHQSITGLYETRIDLSQLGGD
(single underline: HNH domain; double underline:
RuvC domain)
```

The term "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz, G. E. and Schirmer, R. H., Principles of Protein Structure, Springer-Verlag, New York (1979)). According to such analyses, groups of amino acids can be defined where amino acids within a group exchange preferentially with each other, and therefore resemble each other most in their impact on the overall protein structure (Schulz, G. E. and Schirmer, R. H., supra). Non-limiting examples of conservative mutations include amino acid substitutions of amino acids, for example, lysine for arginine and vice versa such that a positive charge can be maintained; glutamic acid for aspartic acid and vice versa such that a negative charge can be maintained; serine for threonine such that a free —OH can be maintained; and glutamine for asparagine such that a free $—NH_2$ can be maintained.

The term "coding sequence" or "protein coding sequence" as used interchangeably herein refers to a segment of a polynucleotide that codes for a protein. The region or sequence is bounded nearer the 5' end by a start codon and nearer the 3' end with a stop codon. Coding sequences can also be referred to as open reading frames.

The term "deaminase" or "deaminase domain," as used herein, refers to a protein or enzyme that catalyzes a deamination reaction. In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytosine deaminase, catalyzing the hydrolytic deamination of cytosine to uracil. In some embodiments, the deaminase is an adenosine deaminase, which catalyzes the hydrolytic deamination of adenine to hypoxanthine. In some embodiments, the deaminase is an adenosine deaminase, which catalyzes the hydrolytic deamination of adenosine or adenine (A) to inosine (I). In some embodiments, the deaminase or deaminase domain is an adenosine deaminase, catalyzing the hydrolytic deamination of adenosine or deoxyadenosine to inosine or deoxyinosine, respectively. In some embodiments, the adenosine deaminase catalyzes the hydrolytic deamination of adenosine in deoxyribonucleic acid (DNA). The adenosine deaminases (e.g. engineered adenosine deaminases, evolved adenosine deaminases) provided herein can be from any organism, such as a bacterium. In some embodiments, the adenosine deaminase is from a bacterium, such as *E. coli, S. aureus, S. typhi, S. putrefaciens, H. influenzae*, or *C. crescentus*. In some embodiments, the adenosine deaminase is a TadA deaminase. In some embodiments, the deaminase or deaminase domain is a variant of a naturally occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, or at least 99.9% identical to a naturally occurring deaminase. For example, deaminase domains are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017)), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "disease" is meant any condition or disorder that damages or interferes with the normal function of a cell, tissue, or organ. An example of a disease includes Rett Syndrome.

By "effective amount" is meant the amount of a required to ameliorate the symptoms of a disease relative to an untreated patient. The effective amount of active compound (s) used to practice the present invention for therapeutic treatment of a disease varies depending upon the manner of administration, the age, body weight, and general health of the subject. Ultimately, the attending physician or veterinarian will decide the appropriate amount and dosage regimen. Such amount is referred to as an "effective" amount. In one embodiment, an effective amount is the amount of a base editor of the invention sufficient to introduce an alteration in a gene of interest (e.g., Mecp2) in a cell (e.g., a cell in vitro or in vivo). In one embodiment, an effective amount is the amount of a base editor required to achieve a therapeutic effect (e.g., to reduce or control Rett Syndrome or a symptom or condition thereof). Such therapeutic effect need not be sufficient to alter Mecp2 in all cells of a subject, tissue or organ, but only to alter Mecp2 in about 1%, 5%, 10%, 25%, 50%, 75% or more of the cells present in a subject, tissue or organ. In one embodiment, an effective amount is sufficient to ameliorate one or more symptoms of Rett Syndrome.

By "fragment" is meant a portion of a polypeptide or nucleic acid molecule. This portion contains, preferably, at least 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

The term "inhibitor of base repair" or "IBR" refers to a protein that is capable in inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 Endol, T4PDG, UDG, hSMUGl, and hAAG. In some embodiments, the IBR is an inhibitor of Endo V or hAAG. In some embodiments, the IBR is a catalytically inactive EndoV or a catalytically inactive hAAG. In some embodiments, the base repair inhibitor is an inhibitor of Endo V or hAAG. In some embodiments, the base repair inhibitor is a catalytically inactive EndoV or a catalytically inactive hAAG. In some embodiments, the base repair inhibitor is uracil glycosylase inhibitor (UGI). UGI refers to a protein that is capable of inhibiting a uracil-DNA glycosylase base-excision repair enzyme. In some embodiments, a UGI domain comprises a wild-type UGI or a fragment of a wild-type UGI. In some embodiments, the UGI proteins provided herein include fragments of UGI and proteins homologous to a UGI or a UGI fragment. In some embodiments, the base repair inhibitor is an inhibitor of inosine base excision repair. In some embodiments, the base repair inhibitor is a "catalytically inactive inosine specific nuclease" or "dead inosine specific nuclease. Without wishing to be bound by any particular theory, catalytically inactive inosine glycosylases (e.g., alkyl adenine glycosylase (AAG)) can bind inosine, but cannot create an abasic site or remove the inosine, thereby sterically blocking the newly formed inosine moiety from DNA damage/repair mechanisms. In some embodiments, the catalytically inactive inosine specific nuclease can be capable of binding an inosine in a nucleic acid but does not cleave the nucleic acid. Non-limiting exemplary catalytically inactive inosine specific nucleases include catalytically inactive alkyl adenosine glycosylase (AAG nuclease), for example, from a human, and catalytically inactive endonuclease V (EndoV nuclease), for example, from *E. coli*. In some embodiments, the catalytically inactive AAG nuclease comprises an E125Q mutation or a corresponding mutation in another AAG nuclease.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high-performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker", as used herein, can refer to a covalent linker (e.g., covalent bond), a non-covalent linker, a chemical group, or a molecule linking two molecules or moieties, e.g. two components of a protein complex or a ribonucleocomplex, or two domains of a fusion protein, such as, for example, a polynucleotide programmable DNA binding domain (e.g. dCas9) and a deaminase domain (e.g., an adenosine deaminase or a cytidine deaminase). A linker can join different components of, or different portions of components of, a base editor system. For example, in some embodiments, a linker can join a guide polynucleotide binding domain of a polynucleotide programmable nucleotide binding domain and a catalytic domain of a deaminase. In some embodiments, a linker can join a CRISPR polypeptide and a deaminase. In some embodiments, a linker can join a Cas9 and a deaminase. In some embodiments, a linker can join a dCas9 and a deaminase. In some embodiments, a linker can join a nCas9 and a deaminase. In some embodiments, a linker can join a guide polynucleotide and a deaminase. In some embodiments, a linker can join a deaminating component and a polynucleotide programmable nucleotide binding component of a base editor system. In some embodiments, a linker can join a RNA-binding portion of a deaminating component and a polynucleotide programmable nucleotide binding component of a base editor system. In some embodiments, a linker can join a RNA-binding portion of a deaminating component and a RNA-binding portion of a polynucleotide programmable nucleotide binding component of a base editor system. A linker can be positioned between, or flanked by, two groups, molecules, or other moieties and connected to each one via a covalent bond or non-covalent interaction, thus connecting the two. In some embodiments, the linker can be an organic molecule, group, polymer, or chemical moiety. In some embodiments, the linker can be a polynucleotide. In some embodiments, the linker can be a DNA linker. In some embodiments, the linker can be a RNA linker. In some embodiments, a linker can comprise an aptamer capable of binding to a ligand. In some embodiments, the ligand may be carbohydrate, a peptide, a protein, or a nucleic acid. In some embodiments, the linker may comprise an aptamer may be derived from a riboswitch. The riboswitch from which the aptamer is derived may be selected from a theophylline riboswitch, a thiamine pyrophosphate (TPP) riboswitch, an adenosine cobalamin (AdoCbl) riboswitch, an S-adenosyl methionine (SAM) riboswitch, an SAH riboswitch, a flavin mononucleotide (FMN) riboswitch, a tetrahydrofolate riboswitch, a lysine riboswitch, a glycine riboswitch, a purine riboswitch, a GlmS riboswitch, or a prequeosine1 (PreQ1) riboswitch. In some embodiments, a linker may comprise an aptamer bound to a polypeptide or a protein domain, such as a polypeptide ligand. In some embodiments, the polypeptide ligand may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif. In some embodiments, the polypeptide ligand may be a portion of a base editor system component. For example, a nucleobase editing component may comprise a deaminase domain and a RNA recognition motif.

In some embodiments, the linker can be an amino acid or a plurality of amino acids (e.g., a peptide or protein). In some embodiments, the linker can be about 5-100 amino acids in length, for example, about 5, 6, 7, 8, 9, 10, 11, 12, 13, 14, 15, 16, 17, 18, 19, 20, 20-30, 30-40, 40-50, 50-60, 60-70, 70-80, 80-90, or 90-100 amino acids in length. In some embodiments, the linker can be about 100-150, 150-200, 200-250, 250-300, 300-350, 350-400, 400-450, or 450-500 amino acids in length. Longer or shorter linkers can be also contemplated.

In some embodiments, a linker joins a gRNA binding domain of an RNA-programmable nuclease, including a Cas9 nuclease domain, and the catalytic domain of a nucleic-acid editing protein (e.g., cytidine or adenosine deaminase). In some embodiments, a linker joins a dCas9 and a nucleic-acid editing protein. For example, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated. In some embodiments, a linker comprises the amino acid sequence SGSETPGTSESATPES (SEQ ID NO: 7), which may also be referred to as the XTEN linker. In some embodiments, a linker comprises the amino acid sequence SGGS (SEQ ID NO: 8). In some embodiments, a linker comprises $(SGGS)_n$ (SEQ ID NO: 9), $(GGGS)_n$ (SEQ ID NO: 10), $(GGGGS)_n$ (SEQ ID NO: 11), $(G)_n$ (SEQ ID NO: 12), $(EAAAK)_n$ (SEQ ID NO: 13), $(GGS)_n$ (SEQ ID NO: 14), SGSETPGTSESATPES (SEQ ID NO: 7), or $(XP)_n$ motif (SEQ ID NO: 15), or a combination of any of these, where n is independently an integer between 1 and 30, and where X is any amino acid. In some embodiments, n is 1, 2, 3, 4, 5, 6, 7, 8, 9, 10, 11, 12, 13, 14, or 15. In some embodiments, a linker comprises a plurality of proline residues and is 5-21, 5-14, 5-9, 5-7 amino acids in length, e.g., PAPAP (SEQ ID NO: 16), PAPAPA (SEQ ID NO: 17), PAPAPAP (SEQ ID NO: 18), PAPAPAPA (SEQ ID NO: 19), $P(AP)_4$ (SEQ ID NO: 20), $P(AP)_7$ (SEQ ID NO: 21), $P(AP)_{10}$ (SEQ ID NO: 22). Such proline-rich linkers are also termed "rigid" linkers.

In some embodiments, the domains of a base editor are fused via a linker that comprises In some embodiments, the domains of a base editor are fused via a linker that comprises the amino acid sequence of SGGSSGSETPGTSESATPESSGGS (SEQ ID NO: 23), SGGSSGGSSGSETPGTSESATPESSGGSSGGS (SEQ ID NO: 24), or GGSGGSPGSPAGSPTSTEEGTSESATPESGPGTSTEPSEGSAPGSPAGSPTSTEEGTSTE PSEGSAPGTSTEPSEGSAPGTSESATPESGPGSEPATSGGSGGS (SEQ ID NO: 25). In some embodiments, domains of the base editor are fused via a linker comprising the amino acid sequence SGSETPGTSESATPES (SEQ ID NO: 7), which may also be referred to as the XTEN linker. In some embodiments, the linker is 24 amino acids in length. In some embodiments, the linker comprises the amino acid sequence SGGSSGGSSGSETPGTSESATPES (SEQ ID NO: 26). In some embodiments, the linker is 40 amino acids in length. In some embodiments, the linker comprises the amino acid sequence SGGSSGGSSGSETPGTSESATPESSGGSSGGSSGGSSGGS (SEQ ID NO: 27). In some embodiments, the linker is 64 amino acids in length. In some embodiments, the linker comprises the amino acid sequence SGGSSGGSSGSETPGTSESATPESSGGSSGGSSGGSSGGSSGSETPGTSESATPESSGGS SGGS (SEQ ID NO: 28). In some embodiments, the linker is 92 amino acids in length. In some embodiments, the linker comprises the amino acid sequence

```
                                                    (SEQ ID NO: 29)
PGSPAGSPTSTEEGTSESATPESGPGTSTEPSEGSAPGSPAGSPTSTEE

GTSTEPSEGSAPGTSTEPSEGSAPGTSESATPESGPGSEPATS.
```

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, Molecular Cloning: A Laboratory Manual (4th ed., Cold Spring Harbor Laboratory Press, Cold Spring Harbor, N.Y. (2012)). In some embodiments, the presently disclosed base editors can efficiently generate an "intended mutation", such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., cytidine base editor or adenosine base editor) bound to a guide polynucleotide (e.g., gRNA), specifically designed to generate the intended mutation. In general, mutations made or identified in a sequence (e.g., an amino acid sequence as described herein) are numbered in relation to a reference (or wild type) sequence, i.e., a sequence that does not contain the mutations. The skilled practitioner in the art would readily understand how to determine the position of mutations in amino acid and nucleic acid sequences relative to a reference sequence.

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (2'—e.g., fluororibose, ribose, 2'-deoxyribose, arabinose, and hexose); and/or modified phosphate groups (e.g., phosphorothioates and 5'-N-phosphoramidite linkages).

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence

```
                                   (SEQ ID NO: 30)
KRTADGSEFESPKKKRKV,

                                   (SEQ ID NO: 31)
KRPAATKKAGQAKKKK,

                                   (SEQ ID NO: 32)
KKTELQTTNAENKTKKL,

                                   (SEQ ID NO: 33)
KRGINDRNFWRGENGRKTR,

                                   (SEQ ID NO: 34)
RKSGKIAAIVVKRPRK,

                                   (SEQ ID NO: 35)
PKKKRKV,
or

                                   (SEQ ID NO: 36)
MDSLLMNRRKFLYQFKNVRWAKGRRETYLC.
```

The term "nucleobase", "nitrogenous base", or "base", used interchangeably herein, refers to a nitrogen-containing biological compound that forms a nucleoside, which in turn is a component of a nucleotide. The ability of nucleobases to form base pairs and to stack one upon another leads directly to long-chain helical structures such as ribonucleic acid (RNA) and deoxyribonucleic acid (DNA). Five nucleobases—adenine (A), cytosine (C), guanine (G), thymine (T), and uracil (U)—are called primary or canonical. Adenine and guanine are derived from purine, and cytosine, uracil, and thymine are derived from pyrimidine. DNA and RNA can also contain other (non-primary) bases that are modified. Non-limiting exemplary modified nucleobases can include hypoxanthine, xanthine, 7-methylguanine, 5,6-dihydrouracil, 5-methylcytosine (m5C), and 5-hydromethylcytosine. Hypoxanthine and xanthine can be created through mutagen presence, both of them through deamination (replacement of the amine group with a carbonyl group). Hypoxanthine can be modified from adenine. Xanthine can be modified from guanine. Uracil can result from deamination of cytosine. A "nucleoside" consists of a nucleobase and a five-carbon sugar (either ribose or deoxyribose). Examples of a nucleoside include adenosine, guanosine, uridine, cytidine, 5-methyluridine (m5U), deoxyadenosine, deoxyguanosine, thymidine, deoxyuridine, and deoxycytidine. Examples of a nucleoside with a modified nucleobase includes inosine (I), xanthosine (X), 7-methylguanosine (m7G), dihydrouridine (D), 5-methylcytidine (m5C), and pseudouridine (Ψ). A "nucleotide" consists of a nucleobase, a five-carbon sugar (either ribose or deoxyribose), and at least one phosphate group.

The term "nucleic acid programmable DNA binding protein" or "napDNAbp" may be used interchangeably with "polynucleotide programmable nucleotide binding domain" to refer to a protein that associates with a nucleic acid (e.g., DNA or RNA), such as a guide nucleic acid, that guides the napDNAbp to a specific nucleic acid sequence. For example, a Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), Cas12a/Cpf1, Cas12b/C2cl, Cas12c/C2c3, Cas12d/CasY, Cas12e/CasX, Cas12g, Cas12h, and Cas12i. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" CRISPR J. 2018 October;1:325-336. doi: 10.1089/crispr.2018.0033; Yan et al., "Functionally diverse type V CRISPR-Cas systems" *Science.* 2019 Jan. 4; 363(6422):88-91. doi: 10.1126/science.aav7271, the entire contents of each are hereby incorporated by reference.

The terms "nucleobase editing domain" or "nucleobase editing protein", as used herein, refers to a protein or enzyme that can catalyze a nucleobase modification in RNA or DNA, such as cytosine (or cytidine) to uracil (or uridine) or thymine (or thymidine), and adenine (or adenosine) to hypoxanthine (or inosine) deaminations, as well as non-templated nucleotide additions and insertions. In some embodiments, the nucleobase editing domain is a deaminase domain (e.g., a cytidine deaminase, a cytosine deaminase, an adenine deaminase, or an adenosine deaminase). In some embodiments, the nucleobase editing domain can be a naturally occurring nucleobase editing domain. In some embodiments, the nucleobase editing domain can be an engineered or evolved nucleobase editing domain from the naturally occurring nucleobase editing domain. The nucleobase editing domain can be from any organism, such as a bacterium, human, chimpanzee, gorilla, monkey, cow, dog, rat, or mouse. For example, nucleobase editing proteins are described in International PCT Application Nos. PCT/2017/045381 (WO 2018/027078) and PCT/US2016/058344 (WO 2017/070632), each of which is incorporated herein by reference for its entirety. Also see, Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

As used herein, "obtaining" as in "obtaining an agent" includes synthesizing, purchasing, or otherwise acquiring the agent.

"Patient" or "subject" as used herein refers to a mammalian subject diagnosed with or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, goats, sheep, rodents (e.g., mice, rabbits, rats, or guinea pigs) and other mammalians that can benefit from the therapies disclosed herein. Exemplary human patients can be male and/or female.

"Patient in need thereof" or "subject in need thereof" is referred to herein as a patient diagnosed with or suspected of having a disease or disorder, for instance, but not restricted to Rett Syndrome (RTT).

The terms "pathogenic mutation", "pathogenic variant", "disease casing mutation", "disease causing variant", "deleterious mutation", or "predisposing mutation" refers to a genetic alteration or mutation that increases an individual's susceptibility or predisposition to a certain disease or disorder. In some embodiments, the pathogenic mutation comprises at least one wild-type amino acid substituted by at least one pathogenic amino acid in a protein encoded by a gene.

The term "non-conservative mutations" involve amino acid substitutions between different groups, for example, lysine for tryptophan, or phenylalanine for serine, etc. In this case, it is preferable for the non-conservative amino acid substitution to not interfere with, or inhibit the biological activity of, the functional variant. The non-conservative amino acid substitution can enhance the biological activity of the functional variant, such that the biological activity of the functional variant is increased as compared to the wild-type protein.

The terms "protein", "peptide", "polypeptide", and their grammatical equivalents are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide can refer to an individual protein or a collection of proteins. One or more of the amino acids in a protein, peptide, or polypeptide can be modified, for example, by the addition of a chemical entity such as a carbohydrate group, a hydroxyl group, a phosphate group, a farnesyl group, an isofarnesyl group, a fatty acid group, a linker for conjugation, functionalization, or other modifications, etc. A protein, peptide, or polypeptide can also be a single molecule or can be a multi-molecular complex. A protein, peptide, or polypeptide can be just a fragment of a naturally occurring protein or peptide. A protein, peptide, or polypeptide can be naturally occurring, recombinant, or synthetic, or any combination thereof. The term "fusion protein" as used herein refers to a hybrid polypeptide which comprises protein domains from at least two different proteins. One protein can be located at the amino-terminal (N-terminal) portion of the fusion protein or at the carboxy-terminal (C-terminal) protein thus forming an amino-terminal fusion protein or a carboxy-terminal fusion protein, respectively. A protein can comprise different domains, for example, a nucleic acid binding domain (e.g., the gRNA binding domain of Cas9 that directs the binding of the protein to a target site) and a nucleic acid cleavage domain, or a catalytic domain of a nucleic acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA or DNA. Any of the proteins provided herein can be produced by any method known in the art. For example, the proteins provided herein can be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

Polypeptides and proteins disclosed herein (including functional portions and functional variants thereof) can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, omithine, α-aminocyclopentane carboxylic acid, α-aminocyclohexane carboxylic acid, α-aminocycloheptane carboxylic acid, α-(2-amino-2-norbornane)-carboxylic acid, μ,γ-diaminobutyric acid, α,β-diaminopropionic acid, homophenylalanine, and α-tert-butylglycine. The polypeptides and proteins can be associated with post-translational modifications of one or more amino acids of the polypeptide constructs. Non-limiting examples of post-translational modifications include phosphorylation, acylation including acetylation and formylation, glycosylation (including N-linked and O-linked), amidation, hydroxylation, alkylation including methylation and ethylation, ubiquitylation, addition of pyrrolidone carboxylic acid, formation of disulfide bridges, sulfation, myristoylation, palmitoylation, isoprenylation, farnesylation, geranylation, glypiation, lipoylation and iodination.

The term "polynucleotide programmable nucleotide binding domain" refers to a protein that associates with a nucleic acid (e.g., DNA or RNA), such as a guide polynucleotide (e.g., guide RNA), that guides the polynucleotide programmable DNA binding domain to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Non-limiting examples of nucleic acid programmable DNA binding proteins include Cas9 (e.g., dCas9 and nCas9), Cas12a/Cpf1, Cas12b/C2cl, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2cl, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx1O, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, though they are not specifically listed in this disclosure.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, the reference is a wild-type or healthy cell.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, preferably at least about 20 amino acids, more preferably at least about 25 amino acids, and even more preferably about 35 amino acids, about 50 amino acids, or about 100 amino acids. For nucleic acids, the length of the reference nucleic acid sequence will generally be at least about 50 nucleotides, preferably at least about 60 nucleotides, more preferably at least about 75 nucleotides, and even more preferably about 100 nucleotides or about 300 nucleotides or any integer thereabout or therebetween.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821(2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases and Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607(2011).

The term "single nucleotide polymorphism (SNP)" is a variation in a single nucleotide that occurs at a specific position in the genome, where each variation is present to some appreciable degree within a population (e.g. >1%). For example, at a specific base position in the human genome, the C nucleotide can appear in most individuals, but in a minority of individuals, the position is occupied by an A. This means that there is a SNP at this specific position, and the two possible nucleotide variations, C or A, are the to be alleles for this position. SNPs underlie differences in susceptibility to disease; a wide range of human diseases. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs. Synonymous S NPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation (e.g., caused by cancer) can also be called a single-nucleotide alteration.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the invention, but which does not substantially recognize and bind other molecules in a sample, for example, a biological sample.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred: embodiment, hybridization will occur at 30° C. in 750 mM NaCl, 75 nM trisodium citrate, and 1% SDS. In a more preferred embodiment, hybridization will occur at 37° C. in 500 mM NaCl, 50 mM trisodium citrate, 1% SDS, 35% formamide, and 100 μg/ml denatured salmon sperm DNA (ssDNA). In a most preferred embodiment, hybridization will occur at 42° C. in 250 mM NaCl, 25 mM trisodium citrate, 1% SDS, 50% formamide, and 200 μg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "subject" is meant a mammal, including, but not limited to, a human or non-human mammal, such as a bovine, equine, canine, ovine, or feline.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). Preferably, such a sequence is at least 60%, more preferably 80% or 85%, and more preferably 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, COBALT, EMBOSS Needle, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence. COBALT is used, for example, with the following parameters:

a) alignment parameters: Gap penalties-11,-1 and End-Gap penalties-5, -1,
b) CDD Parameters: Use RPS BLAST on; Blast E-value 0.003; Find Conserved columns and Recompute on, and
c) Query Clustering Parameters: Use query clusters on; Word Size 4; Max cluster distance 0.8; Alphabet Regular.

EMBOSS Needle is used, for example, with the following parameters:

a) Matrix: BLOSUM62;
b) GAP OPEN: 10;
c) GAP EXTEND: 0.5;
d) OUTPUT FORMAT: pair;
e) END GAP PENALTY: false;
f) END GAP OPEN: 10; and
g) END GAP EXTEND: 0.5.

The term "target site" refers to a sequence within a nucleic acid molecule that is modified by a nucleobase editor. In one embodiment, the target site is deaminated by a deaminase or a fusion protein comprising a deaminase (e.g., a cytidine or an adenine deaminase).

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et ah, Multiplex genome engineering using CRISPR/Cas systems. Science 339, 819-823 (2013); *Mali*, P. et ah, RNA-guided human genome engineering via Cas9. Science 339, 823-826 (2013); Hwang, W. Y. et ah, Efficient genome editing in zebrafish using a CRISPR-Cas system. Nature biotechnology 31, 227-229 (2013); Jinek, M. et ah, RNA-programmed genome editing in human cells. eLife 2, e00471 (2013); Dicarlo, J. E. et ah, Genome engineering in *Saccharomyces cerevisiae* using CRISPR-Cas systems. Nucleic acids research (2013); Jiang, W. et ah RNA-guided editing of bacterial genomes using CRISPR-Cas systems. Nature biotechnology 31, 233-239 (2013); the entire contents of each of which are incorporated herein by reference).

As used herein, the terms "treat," treating," "treatment," and the like refer to reducing or ameliorating a disorder and/or symptoms associated therewith or obtaining a desired pharmacologic and/or physiologic effect. It will be appreciated that, although not precluded, treating a disorder or condition does not require that the disorder, condition or symptoms associated therewith be completely eliminated. In some embodiments, the effect is therapeutic, i.e., without limitation, the effect partially or completely reduces, diminishes, abrogates, abates, alleviates, decreases the intensity of, or cures a disease and/or adverse symptom attributable to the disease. In some embodiments, the effect is preventative, i.e., the effect protects or prevents an occurrence or reoccurrence of a disease or condition. To this end, the presently disclosed methods comprise administering a therapeutically effective amount of a compositions as described herein.

By "uracil glycosylase inhibitor" is meant an agent that inhibits the uracil-excision repair system. In one embodiment, the agent is a protein or fragment thereof that binds a host uracil-DNA glycosylase and prevents removal of uracil residues from DNA.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

DNA editing has emerged as a viable means to modify disease states by correcting pathogenic mutations at the genetic level. Until recently, all DNA editing platforms have functioned by inducing a DNA double strand break (DSB) at a specified genomic site and relying on endogenous DNA repair pathways to determine the product outcome in a semi-stochastic manner, resulting in complex populations of genetic products. Though precise, user-defined repair outcomes can be achieved through the homology directed repair (HDR) pathway, a number of challenges have prevented high efficiency repair using HDR in therapeutically-relevant cell types. In practice, this pathway is inefficient relative to the competing, error-prone non-homologous end joining pathway. Further, HDR is tightly restricted to the G1 and S phases of the cell cycle, preventing precise repair of DSBs in post-mitotic cells. As a result, it has proven difficult or impossible to alter genomic sequences in a user-defined, programmable manner with high efficiencies in these populations.

Nucleobase Editor

Disclosed herein is a base editor or a nucleobase editor for editing, modifying or altering a target nucleotide sequence of a polynucleotide. Described herein is a nucleobase editor or a base editor comprising a polynucleotide programmable nucleotide binding domain and a nucleobase editing domain. A polynucleotide programmable nucleotide binding domain, when in conjunction with a bound guide polynucleotide (e.g., gRNA), can specifically bind to a target polynucleotide sequence (i.e., via complementary base pairing between bases of the bound guide nucleic acid and bases of the target polynucleotide sequence) and thereby localize the base editor to the target nucleic acid sequence desired to be edited. In some embodiments, the target polynucleotide sequence comprises single-stranded DNA or double-stranded DNA. In some embodiments, the target polynucleotide sequence comprises RNA. In some embodiments, the target polynucleotide sequence comprises a DNA-RNA hybrid.

Polynucleotide Programmable Nucleotide Binding Domain

The term "polynucleotide programmable nucleotide binding domain" or "nucleic acid programmable DNA binding protein (napDNAbp)" refers to a protein that associates with a nucleic acid (e.g., DNA or RNA), such as a guide polynucleotide (e.g., guide RNA), that guides the polynucleotide programmable nucleotide binding domain to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. In some embodiments, the polynucleotide programmable nucleotide binding domain is a Cpf1 protein.

CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, and then trimmed 3'-5' exonucleolytically. In nature, DNA-binding and cleavage typically requires protein and both RNAs. However, single guide RNAs ("sgRNA", or simply "gRNA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which is hereby incorporated by reference. Cas9 recognizes a short motif in the CRISPR repeat sequences (the PAM or protospacer adjacent motif) to help distinguish self versus non-self.

Cas9 Domains of Nucleobase Editors

Cas9 nuclease sequences and structures are well known to those of skill in the art (see, e.g., "Complete genome sequence of an M1 strain of *Streptococcus pyogenes*." Ferretti et al., Natl. Acad. Sci. U.S.A. 98:4658-4663(2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences can be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8,9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, a Cas9 nuclease has an inactive (e.g., an inactivated) DNA cleavage domain, that is, the Cas9 is a nickase, referred to as an "nCas9" protein (for "nickase" Cas9). A nuclease-inactivated Cas9 protein can interchangeably be referred to as a "dCas9" protein (for nuclease-dead Cas9). Methods for generating a Cas9 protein (or a fragment thereof) having an inactive DNA cleavage domain are known (See, e.g., Jinek et al, Science. 337:816-821(2012); Qi et al, "Repurposing CRISPR as an RNA-Guided Platform for Sequence-Specific Control of Gene Expression" (2013) Cell. 28; 152(5): 1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al, Science. 337:816-821(2012); Qi et al, Cell. 28;152(5): 1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild type Cas9 corresponds to Cas9 from *Streptococcus pyogenes* (NCBI Reference Sequence: NC_017053.1, nucleotide and amino acid sequences as follows):

(SEQ ID NO: 37)

```
ATGGATAAGAAATACTCAATAGGCTTAGATATCGGCACAAATAGCGTCGGATGGGCGGTGATCA

CTGATGATTATAAGGTTCCGTCTAAAAAGTTCAAGGTTCTGGGAAATACAGACCGCCACAGTAT

CAAAAAAAATCTTATAGGGGCTCTTTTATTTGGCAGTGGAGAGACAGCGGAAGCGACTCGTCTC

AAACGGACAGCTCGTAGAAGGTATACACGTCGGAAGAATCGTATTTGTTATCTACAGGAGATTT

TTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTAT

CATGAGAAATATCCAACTATCTATCATCTGCGAAAAAAATTGGCAGATTCTACTGATAAAGCGG

ATTTGCGCTTAATCTATTTGGCCTTAGCGCATATGATTAAGTTTCGTGGTCATTTTTTGATTGA

GGGAGATTTAAATCCTGATAATAGTGATGTGGACAAACTATTTATCCAGTTGGTACAAATCTAC

AATCAATTATTTGAAGAAAACCCTATTAACGCAAGTAGAGTAGATGCTAAAGCGATTCTTTCTG

CACGATTGAGTAAATCAAGACGATTAGAAAATCTCATTGCTCAGCTCCCCGGTGAGAAGAGAAA

TGGCTTGTTTGGGAATCTCATTGCTTTGTCATTGGGATTGACCCCTAATTTTAAATCAAATTTT

GATTTGGCAGAAGATGCTAAATTACAGCTTTCAAAAGATACTTACGATGATGATTTAGATAATT

TATTGGCGCAAATTGGAGATCAATATGCTGATTTGTTTTTGGCAGCTAAGAATTTATCAGATGC

TATTTTACTTTCAGATATCCTAAGAGTAAATAGTGAAATAACTAAGGCTCCCCTATCAGCTTCA

ATGATTAAGCGCTACGATGAACATCATCAAGACTTGACTCTTTTAAAAGCTTTAGTTCGACAAC
```

-continued

AACTTCCAGAAAAGTATAAAGAAATCTTTTTTGATCAATCAAAAAACGGATATGCAGGTTATAT

TGATGGGGGAGCTAGCCAAGAAGAATTTTATAAATTTATCAAACCAATTTTAGAAAAAATGGAT

GGTACTGAGGAATTATTGGTGAAACTAAATCGTGAAGATTTGCTGCGCAAGCAACGGACCTTTG

ACAACGGCTCTATTCCCCATCAAATTCACTTGGGTGAGCTGCATGCTATTTTGAGAAGACAAGA

AGACTTTTATCCATTTTTAAAAGACAATCGTGAGAAGATTGAAAAAATCTTGACTTTTCGAATT

CCTTATTATGTTGGTCCATTGGCGCGTGGCAATAGTCGTTTTGCATGGATGACTCGGAAGTCTG

AAGAAACAATTACCCCATGGAATTTTGAAGAAGTTGTCGATAAAGGTGCTTCAGCTCAATCATT

TATTGAACGCATGACAAACTTTGATAAAAATCTTCCAAATGAAAAAGTACTACCAAAACATAGT

TTGCTTTATGAGTATTTTACGGTTTATAACGAATTGACAAAGGTCAAATATGTTACTGAGGGAA

TGCGAAAACCAGCATTTCTTTCAGGTGAACAGAAGAAAGCCATTGTTGATTTACTCTTCAAAAC

AAATCGAAAAGTAACCGTTAAGCAATTAAAAGAAGATTATTTCAAAAAAATAGAATGTTTTGAT

AGTGTTGAAATTTCAGGAGTTGAAGATAGATTTAATGCTTCATTAGGCGCCTACCATGATTTGC

TAAAAATTATTAAAGATAAAGATTTTTTGGATAATGAAGAAAATGAAGATATCTTAGAGGATAT

TGTTTTAACATTGACCTTATTTGAAGATAGGGGGATGATTGAGGAAAGACTTAAAACATATGCT

CACCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTTTT

GAAATCAGATGGTTTTGCCAATCGCAATTTTATGCAGCTGATCCATGATGATAGTTTGACATTT

AAAGAAGATATTCAAAAAGCACAGGTGTCTGGACAAGGCCATAGTTTACATGAACAGATTGCTA

ACTTAGCTGGCAGTCCTGCTATTAAAAAAGGTATTTTACAGACTGTAAAAATTGTTGATGAACT

GGTCAAAGTAATGGGGCATAAGCCAGAAAATATCGTTATTGAAATGGCACGTGAAAATCAGACA

ACTCAAAAGGGCCAGAAAAATTCGCGAGAGCGTATGAAACGAATCGAAGAAGGTATCAAAGAAT

TAGGAAGTCAGATTCTTAAAGAGCATCCTGTTGAAAATACTCAATTGCAAAATGAAAAGCTCTA

TCTCTATTATCTACAAAATGGAAGAGACATGTATGTGGACCAAGAATTAGATATTAATCGTTTA

AGTGATTATGATGTCGATCACATTGTTCCACAAAGTTTCATTAAAGACGATTCAATAGACAATA

AGGTACTAACGCGTTCTGATAAAAATCGTGGTAAATCGGATAACGTTCCAAGTGAAGAAGTAGT

CAAAAAGATGAAAAACTATTGGAGACAACTTCTAAACGCCAAGTTAATCACTCAACGTAAGTTT

GATAATTTAACGAAAGCTGAACGTGGAGGTTTGAGTGAACTTGATAAAGCTGGTTTTATCAAAC

GCCAATTGGTTGAAACTCGCCAAATCACTAAGCATGTGGCACAAATTTTGGATAGTCGCATGAA

TACTAAATACGATGAAAATGATAAACTTATTCGAGAGGTTAAAGTGATTACCTTAAAATCTAAA

TTAGTTTCTGACTTCCGAAAAGATTTCCAATTCTATAAAGTACGTGAGATTAACAATTACCATC

ATGCCCATGATGCGTATCTAAATGCCGTCGTTGGAACTGCTTTGATTAAGAAATATCCAAAACT

TGAATCGGAGTTTGTCTATGGTGATTATAAAGTTTATGATGTTCGTAAAATGATTGCTAAGTCT

GAGCAAGAAATAGGCAAAGCAACCGCAAAATATTTCTTTTACTCTAATATCATGAACTTCTTCA

AAACAGAAATTACACTTGCAAATGGAGAGATTCGCAAACGCCCTCTAATCGAAACTAATGGGGA

AACTGGAGAAATTGTCTGGGATAAAGGGCGAGATTTTGCCACAGTGCGCAAAGTATTGTCCATG

CCCCAAGTCAATATTGTCAAGAAAACAGAAGTACAGACAGGCGGATTCTCCAAGGAGTCAATTT

TACCAAAAAGAAATTCGGACAAGCTTATTGCTCGTAAAAAAGACTGGGATCCAAAAAAATATGG

TGGTTTTGATAGTCCAACGGTAGCTTATTCAGTCCTAGTGGTTGCTAAGGTGGAAAAAGGGAAA

TCGAAGAAGTTAAAATCCGTTAAAGAGTTACTAGGGATCACAATTATGGAAAGAAGTTCCTTTG

AAAAAAATCCGATTGACTTTTTAGAAGCTAAAGGATATAAGGAAGTTAAAAAAGACTTAATCAT

TAAACTACCTAAATATAGTCTTTTTGAGTTAGAAAACGGTCGTAAACGGATGCTGGCTAGTGCC

-continued

GGAGAATTACAAAAAGGAAATGAGCTGGCTCTGCCAAGCAAATATGTGAATTTTTTATATTTAG

CTAGTCATTATGAAAAGTTGAAGGGTAGTCCAGAAGATAACGAACAAAAACAATTGTTTGTGGA

GCAGCATAAGCATTATTTAGATGAGATTATTGAGCAAATCAGTGAATTTTCTAAGCGTGTTATT

TTAGCAGATGCCAATTTAGATAAAGTTCTTAGTGCATATAACAAACATAGAGACAAACCAATAC

GTGAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATGCC

ACTCTTATCCATCAATCCATCACTGGTCTTTATGAAACACGCATTGATTTGAGTCAGCTAGGAG

GTGACTGA (SEQ ID NO: 38)

MDKKYSIGLDIGTNSVGWAVITDDYKVPSKKFKVLGNTDRHSIKKNLIGALLFGSGETAEATRL

KRTARRRYTRRKNRICYLQEIFSNEMAKVDDSFFHRLEESFLVEEDKKHERHPIFGNIVDEVAY

HEKYPTIYHLRKKLADSTDKADLRLIYLALAHMIKFRGHFLIEGDLNPDNSDVDKLFIQLVQIY

NQLFEENPINASRVDAKAILSARLSKSRRLENLIAQLPGEKRNGLFGNLIALSLGLTPNFKSNF

DLAEDAKLQLSKDTYDDDLDNLLAQIGDQYADLFLAAKNLSDAILLSDILRVNSEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGAYHDLLKIIKDKDFLDNEENEDILEDIVLTLTLFEDRGMIEERLKTYA

HLFDDKVMKQLKRRRYTGWGRLSRKLINGIRDKQSGKTILDFLKSDGFANRNFMQLIHDDSLTF

KEDIQKAQVSGQGHSLHEQIANLAGSPAIKKGILQTVKIVDELVKVMGHKPENIVIEMARENQT

TQKGQKNSRERMKRIEEGIKELGSQILKEHPVENTQLQNEKLYLYYLQNGRDMYVDQELDINRL

SDYDVDHIVPQSFIKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSK

LVSDFRKDFQFYKVREINNYHHAHDAYLNAVVGTALIKKYPKLESEFVYGDYKVYDVRKMIAKS

EQEIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASA

GELQKGNELALPSKYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTIDRKRYTSTKEVLDA

TLIHQSITGLYETRIDLSQLGGD (single underline: HNH domain; double underline: RuvC domain)

In some embodiments, wild type Cas9 corresponds to, or comprises the following nucleotide and/or amino acid sequences:

(SEQ ID NO: 39)

ATGGATAAAAAGTATTCTATTGGTTTAGACATCGGCACTAATTCCGTTGGATGGGCTGTCATAA

CCGATGAATACAAAGTACCTTCAAAGAAATTTAAGGTGTTGGGGAACACAGACCGTCATTCGAT

TAAAAAGAATCTTATCGGTGCCCTCCTATTCGATAGTGGCGAAACGGCAGAGGCGACTCGCCTG

AAACGAACCGCTCGGAGAAGGTATACACGTCGCAAGAACCGAATATGTTACTTACAAGAAATTT

TTAGCAATGAGATGGCCAAAGTTGACGATTCTTTCTTTCACCGTTTGGAAGAGTCCTTCCTTGT

-continued

CGAAGAGGACAAGAAACATGAACGGCACCCCATCTTTGGAAACATAGTAGATGAGGTGGCATAT

CATGAAAAGTACCCAACGATTTATCACCTCAGAAAAAAGCTAGTTGACTCAACTGATAAAGCGG

ACCTGAGGTTAATCTACTTGGCTCTTGCCCATATGATAAAGTTCCGTGGGCACTTTCTCATTGA

GGGTGATCTAAATCCGGACAACTCGGATGTCGACAAACTGTTCATCCAGTTAGTACAAACCTAT

AATCAGTTGTTTGAAGAGAACCCTATAAATGCAAGTGGCGTGGATGCGAAGGCTATTCTTAGCG

CCCGCCTCTCTAAATCCCGACGGCTAGAAAACCTGATCGCACAATTACCCGGAGAGAAGAAAAA

TGGGTTGTTCGGTAACCTTATAGCGCTCTCACTAGGCCTGACACCAAATTTTAAGTCGAACTTC

GACTTAGCTGAAGATGCCAAATTGCAGCTTAGTAAGGACACGTACGATGACGATCTCGACAATC

TACTGGCACAAATTGGAGATCAGTATGCGGACTTATTTTTGGCTGCCAAAAACCTTAGCGATGC

AATCCTCCTATCTGACATACTGAGAGTTAATACTGAGATTACCAAGGCGCCGTTATCCGCTTCA

ATGATCAAAAGGTACGATGAACATCACCAAGACTTGACACTTCTCAAGGCCCTAGTCCGTCAGC

AACTGCCTGAGAAATATAAGGAAATATTCTTTGATCAGTCGAAAAACGGGTACGCAGGTTATAT

TGACGGCGGAGCGAGTCAAGAGGAATTCTACAAGTTTATCAAACCCATATTAGAGAAGATGGAT

GGGACGGAAGAGTTGCTTGTAAAACTCAATCGCGAAGATCTACTGCGAAAGCAGCGGACTTTCG

ACAACGGTAGCATTCCACATCAAATCCACTTAGGCGAATTGCATGCTATACTTAGAAGGCAGGA

GGATTTTTATCCGTTCCTCAAAGACAATCGTGAAAAGATTGAGAAAATCCTAACCTTTCGCATA

CCTTACTATGTGGGACCCCTGGCCCGAGGGAACTCTCGGTTCGCATGGATGACAAGAAAGTCCG

AAGAAACGATTACTCCATGGAATTTTGAGGAAGTTGTCGATAAAGGTGCGTCAGCTCAATCGTT

CATCGAGAGGATGACCAACTTTGACAAGAATTTACCGAACGAAAAAGTATTGCCTAAGCACAGT

TTACTTTACGAGTATTTCACAGTGTACAATGAACTCACGAAAGTTAAGTATGTCACTGAGGGCA

TGCGTAAACCCGCCTTTCTAAGCGGAGAACAGAAGAAAGCAATAGTAGATCTGTTATTCAAGAC

CAACCGCAAAGTGACAGTTAAGCAATTGAAAGAGGACTACTTTAAGAAAATTGAATGCTTCGAT

TCTGTCGAGATCTCCGGGGTAGAAGATCGATTTAATGCGTCACTTGGTACGTATCATGACCTCC

TAAAGATAATTAAAGATAAGGACTTCCTGGATAACGAAGAGAATGAAGATATCTTAGAAGATAT

AGTGTTGACTCTTACCCTCTTTGAAGATCGGGAAATGATTGAGGAAAGACTAAAAACATACGCT

CACCTGTTCGACGATAAGGTTATGAAACAGTTAAAGAGGCGTCGCTATACGGGCTGGGGACGAT

TGTCGCGGAAACTTATCAACGGGATAAGAGACAAGCAAAGTGGTAAAACTATTCTCGATTTTCT

AAAGAGCGACGGCTTCGCCAATAGGAACTTTATGCAGCTGATCCATGATGACTCTTTAACCTTC

AAAGAGGATATACAAAAGGCACAGGTTTCCGGACAAGGGGACTCATTGCACGAACATATTGCGA

ATCTTGCTGGTTCGCCAGCCATCAAAAAGGGCATACTCCAGACAGTCAAAGTAGTGGATGAGCT

AGTTAAGGTCATGGGACGTCACAAACCGGAAAACATTGTAATCGAGATGGCACGCGAAAATCAA

ACGACTCAGAAGGGGCAAAAAAACAGTCGAGAGCGGATGAAGAGAATAGAAGAGGGTATTAAAG

AACTGGGCAGCCAGATCTTAAAGGAGCATCCTGTGGAAAATACCCAATTGCAGAACGAGAAACT

TTACCTCTATTACCTACAAAATGGAAGGGACATGTATGTTGATCAGGAACTGGACATAAACCGT

TTATCTGATTACGACGTCGATCACATTGTACCCCAATCCTTTTTGAAGGACGATTCAATCGACA

ATAAAGTGCTTACACGCTCGGATAAGAACCGAGGGAAAAGTGACAATGTTCCAAGCGAGGAAGT

CGTAAAGAAAATGAAGAACTATTGGCGGCAGCTCCTAAATGCGAAACTGATAACGCAAAGAAAG

TTCGATAACTTAACTAAAGCTGAGAGGGGTGGCTTGTCTGAACTTGACAAGGCCGGATTTATTA

AACGTCAGCTCGTGGAAACCCGCCAAATCACAAAGCATGTTGCACAGATACTAGATTCCCGAAT

GAATACGAAATACGACGAGAACGATAAGCTGATTCGGGAAGTCAAAGTAATCACTTTAAAGTCA

AAATTGGTGTCGGACTTCAGAAAGGATTTTCAATTCTATAAAGTTAGGGAGATAAATAACTACC

-continued

ACCATGCGCACGACGCTTATCTTAATGCCGTCGTAGGGACCGCACTCATTAAGAAATACCCGAA

GCTAGAAAGTGAGTTTGTGTATGGTGATTACAAAGTTTATGACGTCCGTAAGATGATCGCGAAA

AGCGAACAGGAGATAGGCAAGGCTACAGCCAAATACTTCTTTTATTCTAACATTATGAATTTCT

TTAAGACGGAAATCACICTGGCAAACGGAGAGATACGCAAACGACCTITAATTGAAACCAATGG

GGAGACAGGTGAAATCGTATGGGATAAGGGCCGGGACTTCGCGACGGTGAGAAAAGTTTTGTCC

ATGCCCCAAGTCAACATAGTAAAGAAAACTGAGGTGCAGACCGGAGGGTTTTCAAAGGAATCGA

TTCTTCCAAAAAGGAATAGTGATAAGCTCATCGCTCGTAAAAAGGACTGGGACCCGAAAAAGTA

CGGTGGCTTCGATAGCCCTACAGTTGCCTATTCTGTCCTAGTAGTGGCAAAAGTTGAGAAGGGA

AAATCCAAGAAACTGAAGICAGTCAAAGAATTATTGGGGATAACGATTATGGAGCGCTCGTCTT

TTGAAAAGAACCCCATCGACTTCCTTGAGGCGAAAGGTTACAAGGAAGTAAAAAAGGATCTCAT

AATTAACTACCAAAGTATAGTCTGTTTGAGTTAGAAAATGGCCGAAAACGGATGTTGGCTAGC

GCCGGAGAGCTTCAAAAGGGGAACGAACTCGCACTACCGTCTAAATACGTGATTTCCTGTATT

TAGCGTCCCATTACGAGAAGTTGAAAGGTTCACCTGAAGATAACGAACAGAAGCAACTTTTTGT

TGAGCAGCACAAACATTATCTCGACGAAATCATAGAGCAAATTTCGGAATTCAGTAAGAGAGTC

ATCCTAGCTGATGCCAATCTGGACAAAGTATTAAGCGCATACAACAAGCACAGGGATAAACCCA

TACGTGAGCAGGCGGAAAATATTATCCATTTGTTTACTCTTACCAACCTCGGCGCTCCAGCCGC

ATTCAGTATTTTGACACAACGATAGATCGCAAACGATACACTTCTACCAAGGAGGTGCTAGAC

GCGACACTGATTCACCATCCATCACGGGATTATATGAAACTCGGATAGATTTGTCACAGCTTG

GGGGTGACGGATCCCCCAAGAAGAAGAGGAAAGTCTCGAGCGACTACAAAGACCATGACGGTGA

TTATAAAGATCATGACATCGATTACAAGGATGACGATGACAAGGCTGCAGGA (SEQ ID NO: 40)

MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

-continued

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC domain).

In some embodiments, wild type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows):

(SEQ ID NO: 41)

ATGGATAAGAAATACTCAATAGGCTTAGATATCGGCACAAATAGCGTCGGATGGGCGGTGATCA

CTGATGAATATAAGGTTCCGTCTAAAAAGTTCAAGGTTCTGGGAAATACAGACCGCCACAGTAT

CAAAAAAAATCTTATAGGGGCTCTTTTATTTGACAGTGGAGAGACAGCGGAAGCGACTCGTCTC

AAACGGACAGCTCGTAGAAGGTATACACGTCGGAAGAATCGTATTTGTTATCTACAGGAGATTT

TTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTAT

CATGAGAAATATCCAACTATCTATCATCTGCGAAAAAAATTGGTAGATTCTACTGATAAAGCGG

ATTTGCGCTTAATCTATTTGGCCTTAGCGCATATGATTAAGTTTCGTGGTCATTTTTTGATTGA

GGGAGATTTAAATCCTGATAATAGTGATGTGGACAAACTATTTATCCAGTTGGTACAAACCTAC

AATCAATTATTTGAAGAAAACCCTATTAACGCAAGTGGAGTAGATGCTAAAAGCGATTCTTTCTG

CACGATTGAGTAAATCAAGACGATTAGAAAATCTCATTGCTCAGCTCCCCGGTGAGAAGAAAAA

TGGCTTATTTGGGAATCTCATTGCTTTGTCATTGGGTTTGACCCCTAATTTTAAATCAAATTTT

GATTTGGCAGAAGATGCTAAATTACAGCTTTCAAAAGATACTTACGATGATGATTTAGATAATT

TATTGGCGCAAATTGGAGATCAATATGCTGATTTGTTTTTGGCAGCTAAGAATTTATCAGATGC

TATTTTACTTTCAGATATCCTAAGAGTAAATACTGAAATAACTAAGGCTCCCCTATCAGCTTCA

ATGATTAAACGCTACGATGAACATCATCAAGACTTGACTCTTTTAAAAGCTTTAGTTCGACAAC

AACTTCCAGAAAAGTATAAAGAAATCTTTTTTGATCAATCAAAAAACGGATATGCAGGTTATAT

TGATGGGGGAGCTAGCCAAGAAGAATTTTATAAATTTATCAAACCAATTTTAGAAAAAATGGAT

GGTACTGAGGAATTATTGGTGAAACTAAATCGTGAAGATTTGCTGCGCAAGCAACGGACCTTTG

ACAACGGCTCTATTCCCCATCAAATTCACTTGGGTGAGCTGCATGCTATTTTGAGAAGACAAGA

AGACTTTTATCCATTTTTAAAAGACAATCGTGAGAAGATTGAAAAAATCTTGACTTTTCGAATT

CCTTATTATGTTGGTCCATTGGCGCGTGGCAATAGTCGTTTTGCATGGATGACTCGGAAGTCTG

AAGAAACAATTACCCCATGGAATTTTGAAGAAGTTGTCGATAAAGGTGCTTCAGCTCAATCATT

TATTGAACGCATGACAAACTTTGATAAAAATCTTCCAAATGAAAAAGTACTACCAAAACATAGT

TTGCTTTATGAGTATTTTACGGTTTATAACGAATTGACAAAGGTCAAATATGTTACTGAAGGAA

TGCGAAAACCAGCATTTCTTTCAGGTGAACAGAAGAAAGCCATTGTTGATTTACTCTTCAAAAC

AAATCGAAAAGTAACCGTTAAGCAATTAAAAGAAGATTATTTCAAAAAAATAGAATGTTTTGAT

AGTGTTGAAATTTCAGGAGTTGAAGATAGATTTAATGCTTCATTAGGTACCTACCATGATTTGC

TAAAAATTATTAAAGATAAAGATTTTTTGGATAATGAAGAAAATGAAGATATCTTAGAGGATAT

TGTTTTAACATTGACCTTATTTGAAGATAGGGAGATGATTGAGGAAAGACTTAAAACATATGCT

-continued

CACCTCTTTGATGATAAGGTGATGAAACAGCTTAAACGTCGCCGTTATACTGGTTGGGGACGTT
TGTCTCGAAAATTGATTAATGGTATTAGGGATAAGCAATCTGGCAAAACAATATTAGATTTTTT
GAAATCAGATGGTTTTGCCAATCGCAATTTTATGCAGCTGATCCATGATGATAGTTTGACATTT
AAAGAAGACATTCAAAAAGCACAAGTGTCTGGACAAGGCGATAGTTTACATGAACATATTGCAA
ATTTAGCTGGTAGCCCTGCTATTAAAAAAGGTATTTTACAGACTGTAAAAGTTGTTGATGAATT
GGTCAAAGTAATGGGGCGGCATAAGCCAGAAAATATCGTTATTGAAATGGCACGTGAAAATCAG
ACAACTCAAAAGGGCCAGAAAAATTCGCGAGAGCGTATGAAACGAATCGAAGAAGGTATCAAAG
AATTAGGAAGTCAGATTCTTAAAGAGCATCCTGTTGAAAATACTCAATTGCAAAATGAAAAGCT
CTATCTCTATTATCTCCAAAATGGAAGAGACATGTATGTGGACCAAGAATTAGATATTAATCGT
TTAAGTGATTATGATGTCGATCACATTGTTCCACAAAGTTTCCTTAAAGACGATTCAATAGACA
ATAAGGTCTTAACGCGTTCTGATAAAAATCGTGGTAAATCGGATAACGTTCCAAGTGAAGAAGT
AGTCAAAAAGATGAAAAACTATTGGAGACAACTTCTAAACGCCAAGTTAATCACTCAACGTAAG
TTTGATAATTTAACGAAAGCTGAACGTGGAGGTTTGAGTGAACTTGATAAAGCTGGTTTTATCA
AACGCCAATTGGTTGAAACTCGCCAAATCACTAAGCATGTGGCACAAATTTTGGATAGTCGCAT
GAATACTAAATACGATGAAAATGATAAACTTATTCGAGAGGTTAAAGTGATTACCTTAAAATCT
AAATTAGTTTCTGACTTCCGAAAAGATTTCCAATTCTATAAAGTACGTGAGATTAACAATTACC
ATCATGCCCATGATGCGTATCTAAATGCCGTCGTTGGAACTGCTTTGATTAAGAAATATCCAAA
ACTTGAATCGGAGTTTGTCTATGGTGATTATAAAGTTTATGATGTTCGTAAAATGATTGCTAAG
TCTGAGCAAGAAATAGGCAAAGCAACCGCAAAATATTTCTTTTACTCTAATATCATGAACTTCT
TCAAAACAGAAATTACACTTGCAAATGGAGAGATTCGCAAACGCCCTCTAATCGAAACTAATGG
GGAAACTGGAGAAATTGTCTGGGATAAAGGGCGAGATTTTGCCACAGTGCGCAAAGTATTGTCC
ATGCCCCAAGTCAATATTGTCAAGAAAACAGAAGTACAGACAGGCGGATTCTCCAAGGAGTCAA
TTTTACCAAAAAGAAATTCGGACAAGCTTATTGCTCGTAAAAAAGACTGGGATCCAAAAAAATA
TGGTGGTTTTGATAGTCCAACGGTAGCTTATTCAGTCCTAGTGGTTGCTAAGGTGGAAAAAGGG
AAATCGAAGAAGTTAAAATCCGTTAAAGAGTTACTAGGGATCACAATTATGGAAAGAAGTTCCT
TTGAAAAAAATCCGATTGACTTTTTAGAAGCTAAAGGATATAAGGAAGTTAAAAAAGACTTAAT
CATTAAACTACCTAAATATAGTCTTTTTGAGTTAGAAAACGGTCGTAAACGGATGCTGGCTAGT
GCCGGAGAATTACAAAAAGGAAATGAGCTGGCTCTGCCAAGCAAATATGTGAATTTTTTATATT
TAGCTAGTCATTATGAAAAGTTGAAGGGTAGTCCAGAAGATAACGAACAAAAACAATTGTTTGT
GGAGCAGCATAAGCATTATTTAGATGAGATTATTGAGCAAATCAGTGAATTTTCTAAGCGTGTT
ATTTTAGCAGATGCCAATTTAGATAAAGTTCTTAGTGCATATAACAAACATAGAGACAAACCAA
TACGTGAACAAGCAGAAAATATTATTCATTTATTTACGTTGACGAATCTTGGAGCTCCCGCTGC
TTTTAAATATTTTGATACAACAATTGATCGTAAACGATATACGTCTACAAAAGAAGTTTTAGAT
GCCACTCTTATCCATCAATCCATCACTGGTCTTTATGAAACACGCATTGATTTGAGTCAGCTAG
GAGGTGACTGA (SEQ ID NO: 42)
MDKKYSIGLDIGTNSVGWAVITDEYKVPSKKFKVLGNTDRHSIKKNLIGALLFDSGETAEATRL
KRTARRRYTRRKNRICYLQEIFSNEMAKVDDSFFHRLEESFLVEEDKKHERHPIFGNIVDEVAY
HEKYPTIYHLRKKLVDSTDKADLRLIYLALAHMIKFRGHFLIEGDLNPDNSDVDKLFIQLVQTY
NQLFEENPINASGVDAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDILRVNTEITKAPLSAS

-continued

```
MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD
(single underline: HNH domain; double underline: RuvC domain).
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); Spiroplasma syrphidicola (NCBI Ref: NC_021284.1); *Prevotella intermedia* (NCBI Ref: NC_017861.1); Spiroplasma *taiwanense* (NCBI Ref: NC_021846.1); *Streptococcus* iniae (NCBI Ref: NC_021314.1); Belliella *baltica* (NCBI Ref: NC_018010.1); Psychroflexus torquisI(NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

```
(SEQ ID NO: 43)
MDKKYSIGLAIGTNSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDAIVPQSFLKDDSIDNKVLTRSDKNRGKSDNVPSEEVVKKMKNYWRQLLNAKLITQRK
```

-continued

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC domain).

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, CAS12b/C2c1, and Cas12c/C2c3.

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) Cell. 28;152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., Cell. 28;152(5):1173-83 (2013)).

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments, the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments, the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments, the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a DOA mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124):

(SEQ ID NO: 44)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTEDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

-continued

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD (see, e.g., Qi et al., "Repurposing CRISPR as an RNA-guided platform for sequence-specific control of gene expression." *Cell*. 2013; 152(5): 1173-83, the entire contents of which are incorporated herein by reference).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

Exemplary catalytically inactive Cas9 (dCas9):
(SEQ ID NO: 45)
MDKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGHFLIEGDLNPDN

SDVDKLFIQLVQTYNQLFEENPINASGVDAKAILSARLSKSRRLENLIAQLPGEKKNGLF

GNLIALSLGLTPNFKSNFDLAEDAKLQLSKDTYDDDLDNLLAQIGDQYADLFLAAKNLS

DAILLSDILRVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNGSIPHQIHLG

ELHAILRRQEDFYPFLKDNREKIEKILTFRIPYYVGPLARGNSRFAWMTRKSEETITPWN

FEEVVDKGASAQSFIERMTNFDKNLPNEKVLPKHSLLYEYFTVYNELTKVKYVTEGMR

KPAFLSGEQKKAIVDLLFKTNRKVTVKQLKEDYFKKIECFDSVETSGVEDRFNASLGTY

HDLLKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKAQV

SGQGDSLHEHIANLAGSPAIKKGILQTVKVVDELVKVMGRHKPENIVIEMARENQTTQK

GQKNSRERMKRIEEGIKELGSQILKEHPVENTQLQNEKLYLYYLQNGRDMYVDQELDI

NRLSDYDVDAIVPQSFLKDDSIDNKVLTRSDKNRGKSDNVPSEEVVKKMKNYWRQLL

NAKLITQRKFDNLTKAERGGLSELDKAGFIKRQLVETRQITKHVAQILDSRMNTKYDEN

DKLIREVKVITLKSKLVSDFRKDFQFYKVREINNYHHAHDAYLNAVVGTALIKKYPKLE

SEFVYGDYKVYDVRKMIAKSEQEIGKATAKYFFYSNIMNFFKTEITLANGEIRKRPLIET

-continued

NGETGEIVWDKGRDFATVRKVLSMPQVNIVKKTEVQTGGFSKESILPKRNSDKLIARKK

DWDPKKYGGFDSPTVAYSVLVVAKVEKGKSKKLKSVKELLGITIMERSSFEKNPIDFLE

AKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRIDL

SQLGGD

Exemplary catalytically Cas9 nickase (nCas9):

(SEQ ID NO: 46)

MDKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGHFLIEGDLNPDN

SDVDKLFIQLVQTYNQLFEENPINASGVDAKAILSARLSKSRRLENLIAQLPGEKKNGLF

GNLIALSLGLTPNFKSNFDLAEDAKLQLSKDTYDDDLDNLLAQIGDQYADLFLAAKNLS

DAILLSDILRVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNGSIPHQIHLG

ELHAILRRQEDFYPFLKDNREKIEKILTFRIPYYVGPLARGNSRFAWMTRKSEETITPWN

FEEVVDKGASAQSFIERMTNFDKNLPNEKVLPKHSLLYEYFTVYNELTKVKYVTEGMR

KPAFLSGEQKKAIVDLLFKTNRKVTVKQLKEDYFKKIECFDSVETSGVEDRFNASLGTY

HDLLKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKAQV

SGQGDSLHEHIANLAGSPAIKKGILQTVKVVDELVKVMGRHKPENIVIEMARENQTTQK

GQKNSRERMKRIEEGIKELGSQILKEHPVENTQLQNEKLYLYYLQNGRDMYVDQELDI

NRLSDYDVDHIVPQSFLKDDSIDNKVLTRSDKNRGKSDNVPSEEVVKKMKNYWRQLL

NAKLITQRKFDNLTKAERGGLSELDKAGFIKRQLVETRQITKHVAQILDSRMNTKYDEN

DKLIREVKVITLKSKLVSDFRKDFQFYKVREINNYHHAHDAYLNAVVGTALIKKYPKLE

SEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKK

DWDPKKYGGFDSPTVAYSVLVVAKVEKGKSKKLKSVKELLGITIMERSSFEKNPIDFLE

AKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRIDL

SQLGGD

Exemplary catalytically active Cas9:

(SEQ ID NO: 47)

MDKKYSIGLDIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGHFLIEGDLNPDN

SDVDKLFIQLVQTYNQLFEENPINASGVDAKAILSARLSKSRRLENLIAQLPGEKKNGLF

GNLIALSLGLTPNFKSNFDLAEDAKLQLSKDTYDDDLDNLLAQIGDQYADLFLAAKNLS

DAILLSDILRVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNGSIPHQIHLG

ELHAILRRQEDFYPFLKDNREKIEKILTFRIPYYVGPLARGNSRFAWMTRKSEETITPWN

FEEVVDKGASAQSFIERMTNFDKNLPNEKVLPKHSLLYEYFTVYNELTKVKYVTEGMR

-continued

```
KPAFLSGEQKKAIVDLLFKTNRKVTVKQLKEDYFKKIECFDSVEISGVEDRFNASLGTY

HDLLKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKAQV

SGQGDSLHEHIANLAGSPAIKKGILQTVKVVDELVKVMGRHKPENIVIEMARENQTTQK

GQKNSRERMKRIEEGIKELGSQILKEHPVENTQLQNEKLYLYYLQNGRDMYVDQELDI

NRLSDYDVDHIVPQSFLKDDSIDNKVLTRSDKNRGKSDNVPSEEVVKKMKNYWRQLL

NAKLITQRKFDNLTKAERGGLSELDKAGFIKRQLVETRQITKHVAQILDSRMNTKYDEN

DKLIREVKVITLKSKLVSDFRKDFQFYKVREINNYHHAHDAYLNAVVGTALIKKYPKLE

SEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKK

DWDPKKYGGFDSPTVAYSVLVVAKVEKGKSKKLKSVKELLGITIMERSSFEKNPIDFLE

AKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRIDL

SQLGGD.
```

In some embodiments, Cas9 refers to a Cas9 from archaea (e.g. nanoarchaea), which constitute a domain and kingdom of single-celled prokaryotic microbes. In some embodiments, a nucleic acid programmable DNA binding protein refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, in a base editor system described herein Cas9 is replaced by CasX, or a variant of CasX. In some embodiments, in a base editor system described herein Cas9 is replaced by CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

CasX (uniprot.org/uniprot/F0NN87; uniprot.org/uniprot/F0NH53)
tr|F0NN87|F0NN87_SULIH CRISPR-associated Casx protein
OS = *Sulfolobus islandicus* (strain HVE10/4) GN = SiH_0402
PE = 4 SV = 1

(SEQ ID NO: 48)

```
MEVPLYNIFGDNYIIQVATEAENSTIYNNKVEIDDEELRNVLNLAYKIAKNNEDAAAER

RGKAKKKKGEEGETTTSNIILPLSGNDKNPWTETLKCYNFPTTVALSEVFKNFSQVKEC

EEVSAPSFVKPEFYEFGRSPGMVERTRRVKLEVEPHYLIIAAAGWVLTRLGKAKVSEGD

YVGVNVFTPTRGILYSLIQNVNGIVPGIKPETAFGLWIARKVVSSVTNPNVSVVRIYTISD

AVGQNPTTINGGFSIDLTKLLEKRYLLSERLEAIARNALSISSNMRERYIVLANYIYEYLT

G SKRLEDLLYFANRDLIMNLNSDDGKVRDLKLISAYVNGELIRGEG
```

-continued

>tr|F0NH53|F0NH53_SULIR CRISPR associated protein, Casx
OS = *Sulfolobus islandicus* (strain REY15A) GN = SiRe_0771
PE = 4 SV = 1

(SEQ ID NO: 49)

MEVPLYNIFGDNYIIQVATEAENSTIYNNKVEIDDEELRNVLNLAYKIAKNNEDAAAER

RGKAKKKKGEEGETTTSNIILPLSGNDKNPWTETLKCYNFPTTVALSEVFKNFSQVKEC

EEVSAPSFVKPEFYKFGRSPGMVERTRRVKLEVEPHYLIMAAAGWVLTRLGKAKVSEG

DYVGVNVFTPTRGILYSLIQNVNGIVPGIKPETAFGLWIARKVVSSVTNPNVSVVSIYTIS

DAVGQNPTTINGGFSIDLTKLLEKRDLLSERLEAIARNALSISSNMRERYIVLANYIYEYL

TGSKRLEDLLYFANRDLIMNLNSDDGKVRDLKLISAYVNGELIRGEG

Deltaproteobacteria CasX (SEQ ID NO: 50)

MEKRINKIRKKLSADNATKPVSRSGPMKTLLVRVMTDDLKKRLEKRRKKPEVMPQVIS

NNAANNLRMLLDDYTKMKEAILQVYWQEFKDDHVGLMCKFAQPASKKIDQNKLKPE

MDEKGNLTTAGFACSQCGQPLFVYKLEQVSEKGKAYTNYFGRCNVAEHEKLILLAQLK

PVKDSDEAVTYSLGKFGQRALDFYSIHVTKESTHPVKPLAQIAGNRYASGPVGKALSDA

CMGTIASFLSKYQDIIIEHQKVVKGNQKRLESLRELAGKENLEYPSVTLPPQPHTKEGVD fAYNEVIARVRMWVNLNLWQKLKLSRDDAKPLLRLKGFPSFPVVERRENEVDWWNTI

NEVKKLIDAKRDMGRVFWSGVTAEKRNTILEGYNYLPNENDHKKREGSLENPKKPAK

RQFGDLLLYLEKKYAGDWGKVFDEAWERIDKKIAGLTSHIEREEARNAEDAQSKAVLT

DWLRAKASFVLERLKEMDEKEFYACEIQLQKWYGDLRGNPFAVEAENRVVDISGFSIG

SDGHSIQYRNLLAWKYLENGKREFYLLMNYGKKGRIRFTDGTDIKKSGKWQGLLYGG

GKAKVIDLTFDPDDEQLIILPLAFGTRQGREFIWNDLLSLETGLIKLANGRVIEKTIYNKK

IGRDEPALFVALTFERREVVDPSNIKPVNLIGVARGENIPAVIALTDPEGCPLPEFKDSSG

GPTDILRIGEGYKEKQRAIQAAKEVEQRRAGGYSRKFASKSRNLADDMVRNSARDLFY

HAVTHDAVLVFANLSRGFGRQGKRTFMTERQYTKMEDWLTAKLAYEGLTSKTYLSKT

LAQYTSKTCSNCGFTITYADMDVMLVRLKKTSDGWATTLNNKELKAEYQITYYNRYK

RQTVEKELSAELDRLSEESGNNDISKWTKGRRDEALFLLKKRFSHRPVQEQFVCLDCGH

EVHAAEQAALNIARSWLFLNSNSTEFKSYKSGKQPFVGAWQAFYKRRLKEVWKPNA

CasY (ncbi.nlm.nih.gov/protein/APG80656.1)
>APG80656.1 CRISPR-associated protein CasY [uncultured
Parcubacteria group bacterium]

(SEQ ID NO: 51)

MSKRHPRISGVKGYRLHAQRLEYTGKSGAMRTIKYPLYSSPSGGRTVPREIVSAINDDY

VGLYGLSNFDDLYNAEKRNEEKVYSVLDFWYDCVQYGAVFSYTAPGLLKNVAEVRG

GSYELTKTLKGSHLYDELQIDKVIKFLNKKEISRANGSLDKLKKDIIDCFKAEYRERHKD

QCNKLADDIKNAKKDAGASLGERQKKLFRDFFGISEQSENDKPSFTNPLNLTCCLLPFD

TVNNNRNRGEVLFNKLKEYAQKLDKNEGSLEMWEYIGIGNSGTAFSNFLGEGFLGRLR

ENKITELKKAMMDITDAWRGQEQEEELEKRLRILAALTIKLREPKEDNHWGGYRSDING

KLSSWLQNYINQTVKIKEDLKGHKKDLKKAKEMINRFGESDTKEEAVVSSLLESIEKIVP

DDSADDEKPDIPAIAIYRRFLSDGRLTLNRFVQREDVQEALIKERLEAEKKKKPKKRKK

KSDAEDEKETIDFKELFPHLAKPLKLVPNFYGDSKRELYKKYKNAAIYTDALWKAVEKI

YKSAFSSSLKNSFFDTDFDKDFFIKRLQKIFSVYRRFNTDKWKPIVKNSFAPYCDIVSLAE

NEVLYKPKQSRSRKSAAIDKNRVRLPSTENIAKAGIALARELSVAGFDWKDLLKKEEHE

EYIDLIELHKTALALLLAVTETQLDISALDFVENGTVKDFMKTRDGNLVLEGRFLEMFS

QSIVESELRGLAGLMSRKEFITRSAIQTMNGKQAELLYIPHEFQSAKITTPKEMSRAFLDL

-continued

APAEFATSLEPESLSEKSLLKLKQMRYYPHYFGYELTRTGQGIDGGVAENALRLEKSPV

KKREIKCKQYKTLGRGQNKIVLYVRSSYYQTQFLEWFLHRPKNVQTDVAVSGSFLIDE

KKVKTRWNYDALTVALEPVSGSERVFVSQPFTIFPEKSAEEEGQRYLGIDIGEYGIAYTA

LETTGDSAKILDQNFISDPQLKTLREEVKGLKLDQRRGTFAMPSTKIARIRESLVHSLRNR

IHHLALKHKAKIVYELEVSRFEEGKQKIKKVYATLKKADVYSEIDADKNLQTTVWGKL

AVASEISASYTSQFCGACKKLWRAEMQVDETITTQELIGTVRVIKGGTLIDAIKDFMRPP

IFDENDTPFPKYRDFCDKHHISKKMRGNSCLFICPFCRANADADIQASQTIALLRYVKEE

KKVEDYFERFRKLKNIKVLGQMKKI

It should be appreciated that polynucleotide programmable nucleotide binding domains can also include nucleic acid programmable proteins that bind RNA. For example, the polynucleotide programmable nucleotide binding domain can be associated with a nucleic acid that guides the polynucleotide programmable nucleotide binding domain to an RNA. Other nucleic acid programmable DNA binding proteins are also within the scope of this disclosure, though they are not specifically listed in this disclosure.

Cas proteins that can be used herein include class 1 and class 2. Non-limiting examples of Cas proteins include Cas1, Cas1B, Cas2, Cas3, Cas4, Cas5, Cas5d, Cas5t, Cas5h, Cas5a, Cas6, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, Cas12a/Cpf1, Cas12b/C2cl, Cas12c/C2c3, Cas12d/CasY, Cas12e/CasX, Cas12g, Cas12h, and Cas12i, CARF, DinG, homologues thereof, or modified versions thereof. An unmodified CRISPR enzyme can have DNA cleavage activity, such as Cas9, which has two functional endonuclease domains: RuvC and HNH. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence.

A vector that encodes a CRISPR enzyme that is mutated to with respect, to a corresponding wild-type enzyme such that the mutated CRISPR enzyme lacks the ability to cleave one or both strands of a target polynucleotide containing a target sequence can be used. Cas9 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild type exemplary Cas9 polypeptide (e.g., Cas9 from *S. pyogenes*). Cas9 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild type exemplary Cas9 polypeptide (e.g., from *S. pyogenes*). Cas9 can refer to the wild type or a modified form of the Cas9 protein that can comprise an amino acid change such as a deletion, insertion, substitution, variant, mutation, fusion, chimera, or any combination thereof.

In some embodiments, the methods described herein can utilize an engineered Cas protein. A guide RNA (gRNA) is a short synthetic RNA composed of a scaffold sequence necessary for Cas-binding and a user-defined ~20 nucleotide spacer that defines the genomic target to be modified. Thus, a skilled artisan can change the genomic target of the Cas protein specificity is partially determined by how specific the gRNA targeting sequence is for the genomic target compared to the rest of the genome.

The Cas9 nuclease has two functional endonuclease domains: RuvC and HNH. Cas9 undergoes a second conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some cases, efficiency can be expressed in terms of percentage of successful HDR. For example, a surveyor nuclease assay can be used can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)](e.g., (b+c)/(a+b+c), where "a" is the band intensity of DNA substrate and "b" and "c" are the cleavage products).

In some cases, efficiency can be expressed in terms of percentage of successful NHEJ. For example, a T7 endonuclease I assay can be used to generate cleavage products, and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2})\times 100$, where "a" is the band intensity of DNA substrate and "b" and "c" are the cleavage products (Ran et. al., Cell. 2013 Sep. 12; 154(6):1380-9; and Ran et al., Nat Protoc. 2013 Nov.; 8(11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most cases, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag.

In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some cases, Cas9 is a variant Cas9 protein. A variant Cas9 polypeptide has an amino acid sequence that is different by one amino acid (e.g., has a deletion, insertion, substitution, fusion) when compared to the amino acid sequence of a wild type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some cases, the variant Cas9 protein has no substantial nuclease activity. When a subject Cas9 protein is a variant Cas9 protein that has no substantial nuclease activity, it can be referred to as "dCas9."

In some cases, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some cases, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337(6096):816-21).

In some cases, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some cases, a variant Cas9 protein has a reduced ability to cleave both the complementary and the non-complementary strands of a double stranded target DNA. As a non-limiting example, in some cases, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors H840A, W476A, and WI 126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors H840A, D10A, W476A, and WI 126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some cases, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a_A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins more similar to types I and III than from type II systems. Functional Cpf1 does not require the trans-activating CRISPR RNA (tracrRNA), therefore, only CRISPR (crRNA) is required. This benefits genome editing because Cpf1 is not only smaller than Cas9, but also it has a smaller sgRNA molecule (proximately half as many nucleotides as Cas9). The Cpf1-crRNA complex cleaves target DNA or RNA by identification of a protospacer adjacent motif 5'-YTN-3' in contrast to the G-rich PAM targeted by Cas9. After identification of PAM, Cpf1 introduces a sticky-end-like DNA double-stranded break of 4 or 5 nucleotides overhang.

Some aspects of the disclosure provide fusion proteins comprising domains that act as nucleic acid programmable DNA binding proteins, which may be used to guide a protein, such as a base editor, to a specific nucleic acid (e.g., DNA or RNA) sequence. In particular embodiments, a fusion protein comprises a nucleic acid programmable DNA binding protein domain and a deaminase domain. DNA binding proteins include, without limitation, Cas9 (e.g., dCas9 and nCas9), Cas12a/Cpf1, Cas12b/C2cl, Cas12c/C2c3, Cas12d/CasY, Cas12e/CasX, Cas12g, Cas12h, and Cas12i. One example of a programmable polynucleotide-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." Cell (165) 2016, p. 949-962; the entire contents of which is hereby incorporated by reference.

Also useful in the present compositions and methods are nuclease-inactive Cpf1 (dCpf1) variants that may be used as a guide nucleotide sequence-programmable polynucleotide-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., Cell, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable nucleotide binding protein of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A. It should be appreciated that Cpf1 from other bacterial species may also be used in accordance with the present disclosure.

Wild type *Francisella novicida* Cpf1 (D917, E1006, and D1255 are bolded and underlined)

(SEQ ID NO: 52)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSI_D_RGERHLAYYTLVDGKGNIIKQDTFNIIGNDRMKTNYHDKLAAIE

KDRDSARKDWKKINNIKEMKEGYLSQVVHEIAKLVIEYNAIVVF_E_DLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

_D_ANGAYHIGLKGLMLLGRIKNNQEGKKLNLVIKNEEYFEFVQNRNN

*Francisella novicida* Cpf1 D917A (A917, E1006, and D1255 are bolded and underlined)

(SEQ ID NO: 53)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

-continued

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIARGERHLAYYTLVDGKGNIIKQDTFNIIGNDRMKTNYHDKLAAIE

KDRDSARKDWKKINNIKEMKEGYLSQVVHEIAKLVIEYNAIVVFEDLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 E1006A (D917, A1006, and D1255 are bolded and underlined)

(SEQ ID NO: 54)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIDRGERHLAYYTLVDGKGNIIKQDTFNIIGNDRMKTNYHDKLAAIE

KDRDSARKDWKKINNIKEMKEGYLSQVVHEIAKLVIEYNAIVVFADLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

-continued

*Francisella novicida* Cpf1 D1255A (D917, E1006, and A1255 are bolded and underlined)

(SEQ ID NO: 55)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSI_D_RGERHLAYYTLVDGKGNIIKQDTFNIIGNDRMKTNYHDKLAAIE

KDRDSARKDWKKINNIKEMKEGYLSQVVHEIAKLVIEYNAIVVF_E_DLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

_A_ANGAYHIGLKGLMLLGRIKNNQEGKKLNLVIKNEEYFEFVQNRNN

*Francisella novicida* Cpf1 D917A/E1006A (A917, A1006, and D1255 are bolded and underlined)

(SEQ ID NO: 56)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSI_A_RGERHLAYYTLVDGKGNIIKQDTFNIIGNDRMKTNYHDKLAAIE

-continued

KDRDSARKDWKKINNIKEMKEGYLSQVVHEIAKLVIEYNAIVVFADLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

DANGAYHIGLKGLMLLGRIKNNQEGKKLNLVIKNEEYFEFVQNRNN

*Francisella novicida* Cpf1 D917A/D1255A (A917, E1006, and A1255 are bolded and underlined)

(SEQ ID NO: 57)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIARGERHLAYYTLVDGKGNIIKQDTFNIIGNDRMKTNYHDKLAAIE

KDRDSARKDWKKINNIKEMKEGYLSQVVHEIAKLVIEYNAIVVFEDLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 E1006A/D1255A (D917, A1006, and A1255 are bolded and underlined)

(SEQ ID NO: 58)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

-continued

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIDRGERHLAYYTLVDGKGNIIKQDTFNIIGNDRMKTNYHDKLAAIE

KDRDSARKDWKKINNIKEMKEGYLSQVVHEIAKLVIEYNAIVVFADLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

*Francisella novicida* Cpf1 D917A/E1006A/D1255A (A917, A1006, and A1255 are bolded and underlined)

(SEQ ID NO: 59)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFK

TVEEKSIKETLSLLFDDLKAQKLDLSKIYFKNDKSLTDLSQQVFDDYSVIGTAVLEYITQ

QIAPKNLDNPSKKEQELIAKKTEKAKYLSLETIKLALEEFNKHRDIDKQCRFEEILANFA

AIPMIFDEIAQNKDNLAQISIKYQNQGKKDLLQASAEDDVKAIKDLLDQTNNLLHKLKIF

HISQSEDKANILDKDEHFYLVFEECYFELANIVPLYNKIRNYITQKPYSDEKFKLNFENST

LANGWDKNKEPDNTAILFIKDDKYYLGVMNKKNNKIFDDKAIKENKGEGYKKIVYKL

LPGANKMLPKVFFSAKSIKFYNPSEDILRIRNHSTHTKNGSPQKGYEKFEFNIEDCRKFID

FYKQSISKHPEWKDFGFRFSDTQRYNSIDEFYREVENQGYKLTFENISESYIDSVVNQGK

LYLFQIYNKDFSAYSKGRPNLHTLYWKALFDERNLQDVVYKLNGEAELFYRKQSIPKKI

THPAKEAIANKNKDNPKKESVFEYDLIKDKRFTEDKFFFHCPITINFKSSGANKFNDEINL

LLKEKANDVHILSIARGERHLAYYTLVDGKGNIIKQDTFNIIGNDRMKTNYHDKLAAIE

KDRDSARKDWKKINNIKEMKEGYLSQVVHEIAKLVIEYNAIVVFADLNFGFKRGRFKV

EKQVYQKLEKMLIEKLNYLVFKDNEFDKTGGVLRAYQLTAPFETFKKMGKQTGIIYYV

PAGFTSKICPVTGFVNQLYPKYESVSKSQEFFSKFDKICYNLDKGYFEFSFDYKNFGDKA

AKGKWTIASFGSRLINFRNSDKNHNWDTREVYPTKELEKLLKDYSIEYGHGECIKAAIC

GESDKKFFAKLTSVLNTILQMRNSKTGTELDYLISPVADVNGNFFDSRQAPKNMPQDA

AANGAYHIGLKGLMLLGRIKNNQEGKKLNLVIKNEEYFEFVQNRNN

In some embodiments, one of the Cas9 domains present in the fusion protein may be replaced with a guide nucleotide sequence-programmable DNA-binding protein domain that has no requirements for a PAM sequence.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR- Cas systems (Cas12b/C2c1, and Cas12c/C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, Cas12b/C2c1, and Cas12c/C2c3, contain RuvC-like endonuclease domains related to Cpf1. A third system, contains an effector with two predicated HEPN RNase domains. Production of mature CRISPR RNA is tracrRNA-independent, unlike production of CRISPR RNA by Cas12b/C2cl. Cas12b/C2c1 depends on both CRISPR RNA and tracrRNA for DNA cleavage.

The crystal structure of *Alicyclobaccillus acidoterrastris* Cas12b/C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", Mol. Cell, 2017 Jan. 19; 65(2):310-322, the entire contents of which are hereby incorporated by reference. The crystal structure has also been reported in *Alicyclobacillus acidoterrestris* C2cl bound to target DNAs as ternary complexes. See e.g., Yang et al., "PAM-dependent Target DNA Recognition and Cleavage by C2C1 CRISPR-Cas endonuclease", Cell, 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2c1 protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2c1 or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2c1 or Cas12c/C2c3 from other bacterial species may also be used in accordance with the present disclosure.

Cas12b/C2c1 (uniprot.org/uniprot/T0D7A2#2) Sp|T0D7A2|/C2C1_ALIAG CRISPR-associated endonuclease C2c1 OS == *Alicyclobacillus acidoterrestris* ((strain ATCC 49025/DSM 3922/CIP 106132/NCIMB 13137/GD3B) GN = c2c1 PE = 1 SV = 1

(SEQ ID NO: 60)

MAVKSIKVKLRLDDMPEIRAGLWKLHKEVNAGVRYYTEWLSLLRQENLYR

RSPNGDGEQECDKTAEECKAELLERLRARQVENGHRGPAGSDDELLQLAR

QLYELLVPQAIGAKGDAQQIARKFLSPLADKDAVGGLGIAKAGNKPRWVR

-continued

MREAGEPGWEEEKEKAETRKSADRTADVLRALADFGLKPLMRVYTDSEMS

SVEWKPLRKGQAVRTWDRDMFQQAIERMMSWESWNQRVGQEYAKLVEQKN

RFEQKNFVGQEHLVHLVNQLQQDMKEASPGLESKEQTAHYVTGRALRGSD

KVFEKWGKLAPDAPFDLYDAEIKNVQRRNTRRFGSHDLFAKLAEPEYQAL

WREDASFLTRYAVYNSILRKLNHAKMFATFTLPDATAHPIWTRFDKLGGN

LHQYTFLFNEFGERRHAIRFHKLLKVENGVAREVDDVTVPISMSEQLDNL

LPRDPNEPIALYFRDYGAEQHFTGEFGGAKIQCRRDQLAHMHRRRGARDV

YLNVSVRVQSQSEARGERRPPYAAVFRLVGDNHRAFVHFDKLSDYLAEHP

DDGKLGSEGLLSGLRVMSVDLGLRTSASISVFRVARKDELKPNSKGRVPF

FFPIKGNDNLVAVHERSQLLKLPGETESKDLRAIREERQRTLRQLRTQLA

YLRLLVRCGSEDVGRRERSWAKLIEQPVDAANHMTPDWREAFENELQKLK

SLHGICSDKEWMDAVYESVRRVWRHMGKQVRDWRKDVRSGERPKIRGYAK

DVVGGNSIEQIEYLERQYKFLKSWSFFGKVSGQVIRAEKGSRFAITLREH

IDHAKEDRLKKLADRIIMEALGYVYALDERGKGKWVAKYPPCQLILLEEL

SEYQFNNDRPPSENNQLMQWSHRGVFQELINQAQVHDLLVGTMYAAFSSR

FDARTGAPGIRCRRVPARCTQEHNPEPFPWWLNKFVVEHTLDACPLRADD

LIPTGEGEIFVSPFSAEEGDFHQIHADLNAAQNLQQRLWSDFDISQIRLR

CDWGEVDGELVLIPRLTGKRTADSYSNKVFYTNTGVTYYERERGKKRRKV

FAQEKLSEEEAELLVEADEAREKSVVLMRDPSGIINRGNWTRQKEFWSMV

NQRIEGYLVKQIRSRVPLQDSACENTGDI

BhCas12b (*Bacillus hisashii*) NCBI Reference Sequence: WP_095142515

(SEQ ID NO: 61)

MAPKKKRKVGIHGVPAAATRSFILKIEPNEEVKKGLWKTHEVLNHGIAYY

MNILKLIRQEAIYEHHEQDPKNPKKVSKAEIQAELWDFVLKMQKCNSFTH

EVDKDEVFNILRELYEELVPSSVEKKGEANQLSNKFLYPLVDPNSQSGKG

TASSGRKPRWYNLKIAGDPSWEEEKKKWEEDKKKDPLAKILGKLAEYGLI

PLFIPYTDSNEPIVKEIKWMEKSRNQSVRRLDKDMFIQALERFLSWESWN

LKVKEEYEKVEKEYKTLEERIKEDIQALKALEQYEKERQEQLLRDTLNTN

EYRLSKRGLRGWREIIQKWLKMDENEPSEKYLEVFKDYQRKHPREAGDYS

VYEFLSKKENHFIWRNHPEYPYLYATFCEIDKKKKDAKQQATFTLADPIN

HPLWVRFEERSGSNLNKYRILTEQLHTEKLKKKLTVQLDRLIYPTESGGW

EEKGKVDIVLLPSRQFYNQIFLDIEEKGKHAFTYKDESIKFPLKGTLGGA

RVQFDRDHLRRYPHKVESGNVGRIYFNMTVNIEPTESPVSKSLKIHRDDF

PKVVNFKPKELTEWIKDSKGKKLKSGIESLEIGLRVMSIDLGQRQAAAAS

IFEVVDQKPDIEGKLFFPIKGTELYAVHRASFNIKLPGETLVKSREVLRK

AREDNLKLMNQKLNFLRNVLHFQQFEDITEREKRVTKWISRQENSDVPLV

YQDELIQIRELMYKPYKDWVAFLKQLHKRLEVEIGKEVKHWRKSLSDGRK

GLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYN

PYEERSRFENSKLMKWSRREIPRQVALQGEIYGLQVGEVGAQFSSRFHAK

TGSPGIRCSVVTKEKLQDNRFFKNLQREGRLTLDKIAVLKEGDLYPDKGG

-continued

EKFISLSKDRKCVTTHADINAAQNLQKRFWTRTHGFYKVYCKAYQVDGQT

VYIPESKDQKQKIIEEFGEGYFILKDGVYEWVNAGKLKIKKGSSKQSSSE

LVDSDILKDSFDLASELKGEKLMLYRDPSGNVFPSDKWMAAGVFFGKLER

ILISKLTNQYSISTIEDDSSKQSMKRPAATKKAGQAKKKK

In some embodiments, the Cas12b is BvCas12B, which is a variant of BhCas12b and comprises the following changes relative to BhCas12B: S893R, K846R, and E837G.

BvCas12b (*Bacillus* sp. V3-13) NCBI Reference Sequence: WP_101661451.1

(SEQ ID NO: 62)

MAIRSIKLKMKTNSGTDSIYLRKALWRTHQLINEGIAYYMNLLTLYRQEA

IGDKTKEAYQAELINIIRNQQRNNGSSEEHGSDQEILALLRQLYELIIPS

SIGESGDANQLGNKFLYPLVDPNSQSGKGTSNAGRKPRWKRLKEEGNPDW

ELEKKKDEERKAKDPTVKIFDNLNKYGLLPLFPLFTNIQKDIEWLPLGKR

QSVRKWDKDMFIQAIERLLSWESWNRRVADEYKQLKEKTESYYKEHLTGG

EEWIEKIRKFEKERNMELEKNAFAPNDGYFITSRQIRGWDRVYEKWSKLP

ESASPEELWKVVAEQQNKMSEGFGDPKVFSFLANRENRDIWRGHSERIYH

IAAYNGLQKKLSRTKEQATFTLPDAIEHPLWIRYESPGGTNLNLFKLEEK

QKKNYYVTLSKIIWPSEEKWIEKENIEIPLAPSIQFNRQIKLKQHVKGKQ

EISFSDYSSRISLDGVLGGSRIQFNRKYIKNHKELLGEGDIGPVFFNLVV

DVAPLQETRNGRLQSPIGKALKVISSDFSKVIDYKPKELMDWMNTGSASN

SFGVASLLEGMRVMSIDMGQRTSASVSIFEVVKELPKDQEQKLFYSINDT

ELFAIHKRSFLLNLPGEVVTKNNKQQRQERRKKRQFVRSQIRMLANVLRL

ETKKTPDERKKAIHKLMEIVQSYDSWTASQKEVWEKELNLLTNMAAFNDE

IWKESLVELHHRIEPYVGQIVSKWRKGLSEGRKNLAGISMWNIDELEDTR

RLLISWSKRSRTPGEANRIETDEPFGSSLLQHIQNVKDDRLKQMANLIIM

TALGFKYDKEEKDRYKRWKETYPACQIILFENLNRYLFNLDRSRRENSRL

MKWAHRSIPRTVSMQGEMFGLQVGDVRSEYSSRFHAKTGAPGIRCHALTE

EDLKAGSNTLKRLIEDGFINESELAYLKKGDIIPSQGGELFVTLSKRYKK

DSDNNELTVIHADINAAQNLQKRFWQQNSEVYRVPCQLARMGEDKLYIPK

SQTETIKKYFGKGSFVKNNTEQEVYKWEKSEKMKIKTDTTFDLQDLDGFE

DISKTIELAQEQQKKYLTMFRDPSGYFFNNETWRPQKEYWSIVNNIIKSC

LKKKILSNKVEL.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT or a NNNRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

In some embodiments, the variant Cas protein can be SpCas9, SpCas9-VRQR, SpCas9-VRER, xCas9 (sp), SaCas9, SaCas9-KKH, SpCas9-MQKSER, SpCas9-LRKIQK, or SpCas9-LRVSQL.

Exemplary SaCas9 sequence (SEQ ID NO: 63)

KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEENSKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNRELIN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFYNNDLIKINGELYRV

IGVNNDLLNRIEVNMIDITYREYLENMNDKRPPRIIKTIASKTQSIKK

YSTDILGNLYEVKSKKHPQIIKKG

Residue N579 above, which is underlined and in bold, may be mutated (e.g., to a A579) to yield a SaCas9 nickase.

Exemplary SaCas9n sequence (SEQ ID NO: 64)

KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

-continued

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEEASKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNRELIN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFYNNDLIKINGELYRV

IGVNNDLLNRIEVNMIDITYREYLENMNDKRPPRIIKTIASKTQSIKKY

STDILGNLYEVKSKKHPQIIKKG

Residue A579 above, which can be mutated from N579 to yield a SaCas9 nickase, is underlined and in bold.

Exemplary SaKKH Cas9

(SEQ ID NO: 65)

KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEEASKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNR*K*LIN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

-continued

GNKLNAHLDITDDYPNSRNKVVKLSLKPYRFDVYLDNGVYKFVTVKNLD

VIKKENYYEVNSKCYEEAKKLKKISNQAEFIASFY*K*NDLIKINGELYRV

IGVNNDLLNRIEVNMIDITYREYLENNINDKRPP*H*IIKTIASKTQSIKK

YSTDILGNLYEVKSKKHPQIIKKG.

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics.

A polynucleotide programmable nucleotide binding domain of a base editor can itself comprise one or more domains. For example, a polynucleotide programmable nucleotide binding domain can comprise one or more nuclease domains. In some embodiments, the nuclease domain of a polynucleotide programmable nucleotide binding domain can comprise an endonuclease or an exonuclease. Herein the term "exonuclease" refers to a protein or polypeptide capable of digesting a nucleic acid (e.g., RNA or DNA) from free ends, and the term "endonuclease" refers to a protein or polypeptide capable of catalyzing (e.g. cleaving) internal regions in a nucleic acid (e.g., DNA or RNA). In some embodiments, an endonuclease can cleave a single strand of a double-stranded nucleic acid. In some embodiments, an endonuclease can cleave both strands of a double-stranded nucleic acid molecule. In some embodiments a polynucleotide programmable nucleotide binding domain can be a deoxyribonuclease. In some embodiments a polynucleotide programmable nucleotide binding domain can be a ribonuclease.

In some embodiments, a nuclease domain of a polynucleotide programmable nucleotide binding domain can cut zero, one, or two strands of a target polynucleotide. In some cases, the polynucleotide programmable nucleotide binding domain can comprise a nickase domain. Herein the term "nickase" refers to a polynucleotide programmable nucleotide binding domain comprising a nuclease domain that is capable of cleaving only one strand of the two strands in a duplexed nucleic acid molecule (e.g. DNA). In some embodiments, a nickase can be derived from a fully catalytically active (e.g. natural) form of a polynucleotide programmable nucleotide binding domain by introducing one or more mutations into the active polynucleotide programmable nucleotide binding domain. For example, where a polynucleotide programmable nucleotide binding domain comprises a nickase domain derived from Cas9, the Cas9-derived nickase domain can include a D10A mutation and a histidine at position 840. In such cases, the residue H840 retains catalytic activity and can thereby cleave a single strand of the nucleic acid duplex. In another example, a Cas9-derived nickase domain can comprise an H840A mutation, while the amino acid residue at position 10 remains a D. In some embodiments, a nickase can be derived from a fully catalytically active (e.g. natural) form of a polynucleotide programmable nucleotide binding domain by removing all or a portion of a nuclease domain that is not required for the nickase activity. For example, where a polynucleotide programmable nucleotide binding domain comprises a nickase domain derived from Cas9, the Cas9-derived nickase domain can comprise a deletion of all or a portion of the RuvC domain or the HNH domain.

A base editor comprising a polynucleotide programmable nucleotide binding domain comprising a nickase domain is thus able to generate a single-strand DNA break (nick) at a specific polynucleotide target sequence (e.g. determined by the complementary sequence of a bound guide nucleic acid). In some embodiments, the strand of a nucleic acid duplex target polynucleotide sequence that is cleaved by a base editor comprising a nickase domain (e.g. Cas9-derived nickase domain) is the strand that is not edited by the base editor (i.e., the strand that is cleaved by the base editor is opposite to a strand comprising a base to be edited). In other embodiments, a base editor comprising a nickase domain (e.g. Cas9-derived nickase domain) can cleave the strand of a DNA molecule which is being targeted for editing. In such cases, the non-targeted strand is not cleaved.

Also provided herein are base editors comprising a polynucleotide programmable nucleotide binding domain which is catalytically dead (i.e., incapable of cleaving a target polynucleotide sequence). Herein the terms "catalytically dead" and "nuclease dead" are used interchangeably to refer to a polynucleotide programmable nucleotide binding domain which has one or more mutations and/or deletions resulting in its inability to cleave a strand of a nucleic acid. In some embodiments, a catalytically dead polynucleotide programmable nucleotide binding domain base editor can lack nuclease activity as a result of specific point mutations in one or more nuclease domains. For example, in the case of a base editor comprising a Cas9 domain, the Cas9 can comprise both a D10A mutation and an H840A mutation. Such mutations inactivate both nuclease domains, thereby resulting in the loss of nuclease activity. In other embodiments, a catalytically dead polynucleotide programmable nucleotide binding domain can comprise one or more deletions of all or a portion of a catalytic domain (e.g. RuvC1 and/or HNH domains). In further embodiments, a catalytically dead polynucleotide programmable nucleotide binding domain comprises a point mutation (e.g. D10A or H840A) as well as a deletion of all or a portion of a nuclease domain.

Also contemplated herein are mutations capable of generating a catalytically dead polynucleotide programmable nucleotide binding domain from a previously functional version of the polynucleotide programmable nucleotide binding domain. For example, in the case of catalytically dead Cas9 ("dCas9"), variants having mutations other than D10A and H840A are provided, which result in nuclease inactivated Cas9. Such mutations, by way of example, include other amino acid substitutions at D10 and H840, or other substitutions within the nuclease domains of Cas9 (e.g., substitutions in the HNH nuclease subdomain and/or the RuvC1 subdomain).

Additional suitable nuclease-inactive dCas9 domains can be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. Nature Biotechnology. 2013; 31(9): 833-838, the entire contents of which are incorporated herein by reference). In some embodiments, the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN). In some cases, a base editor comprises a polynucleotide programmable nucleotide binding domain comprising a natural or modified protein or portion thereof which via a bound guide nucleic acid is capable of binding to a nucleic acid sequence during CRISPR (i.e., Clustered Regularly Interspaced Short Palindromic Repeats)-mediated modification of a nucleic acid. Such a protein is referred to herein as a "CRISPR protein". Accordingly, disclosed herein is a base editor comprising a polynucleotide programmable nucleotide binding domain comprising all or a portion of a CRISPR protein (i.e. a base editor comprising as a domain all or a portion of a CRISPR protein, also referred to as a "CRISPR protein-derived domain" of the base editor). A CRISPR protein-derived domain incorporated into a base editor can be modified compared to a wild-type or natural version of the CRISPR protein. For example, as described below a CRISPR protein-derived domain can comprise one or more mutations, insertions, deletions, rearrangements and/or recombinations relative to a wild-type or natural version of the CRISPR protein.

In some embodiments, a CRISPR protein-derived domain incorporated into a base editor is an endonuclease (e.g., deoxyribonuclease or ribonuclease) capable of binding a target polynucleotide when in conjunction with a bound guide nucleic acid. In some embodiments, a CRISPR protein-derived domain incorporated into a base editor is a nickase capable of binding a target polynucleotide when in conjunction with a bound guide nucleic acid. In some embodiments, a CRISPR protein-derived domain incorporated into a base editor is a catalytically dead domain capable of binding a target polynucleotide when in conjunction with a bound guide nucleic acid. In some embodiments, a target polynucleotide bound by a CRISPR protein derived domain of a base editor is DNA. In some embodiments, a target polynucleotide bound by a CRISPR protein-derived domain of a base editor is RNA.

In some embodiments, a CRISPR protein-derived domain of a base editor can include all or a portion of Cas9 from *Corynebacterium ulcerans* (NCBI Refs: NC_015683.1, NC_017317.1); *Corynebacterium diphtheria* (NCBI Refs: NC_016782.1, NC_016786.1); Spiroplasma syrphidicola (NCBI Ref: NC_021284.1); *Prevotella intermedia* (NCBI Ref: NC_017861.1); Spiroplasma *taiwanense* (NCBI Ref: NC_021846.1); *Streptococcus* iniae (NCBI Ref: NC_021314.1); Belliella *baltica* (NCBI Ref: NC_018010.1); Psychroflexus torquis (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); *Neisseria meningitidis* (NCBI Ref: YP_002342100.1), *Streptococcus pyogenes*, or *Staphylococcus aureus*.

In some embodiments, a Cas9-derived domain of a base editor is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 domain comprises a N579X mutation. In some embodiments, the SaCas9 domain comprises a N579A mutation. In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation.

A base editor can comprise a domain derived from all or a portion of a Cas9 that is a high fidelity Cas9. In some embodiments, high fidelity Cas9 domains of a base editor are engineered Cas9 domains comprising one or more mutations that decrease electrostatic interactions between the Cas9 domain and the sugar-phosphate backbone of a DNA, relative to a corresponding wild-type Cas9 domain. High fidelity Cas9 domains that have decreased electrostatic interactions with the sugar-phosphate backbone of DNA can have less off-target effects. In some embodiments, the Cas9 domain (e.g., a wild type Cas9 domain) comprises one or more mutations that decrease the association between the Cas9 domain and the sugar-phosphate backbone of a DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, or more.

In some embodiments, the modified Cas9 is a high fidelity Cas9 enzyme. In some embodiments, the high fidelity Cas9 enzyme is SpCas9 (K855A), eSpCas9(1.1), SpCas9-HF1, or hyper accurate Cas9 variant (HypaCas9). The modified Cas9 eSpCas9(1.1) contains alanine substitutions that weaken the interactions between the HNH/RuvC groove and the non-target DNA strand, preventing strand separation and cutting at off-target sites. Similarly, SpCas9-HF1 lowers off-target editing through alanine substitutions that disrupt Cas9's interactions with the DNA phosphate backbone. HypaCas9 contains mutations (SpCas9 N692A/M694A/Q695A/H698A) in the REC3 domain that increase Cas9 proofreading and target discrimination. All three high fidelity enzymes generate less off-target editing than wildtype Cas9. An exemplary high fidelity Cas9 is provided below.

High Fidelity Cas9 domain mutations relative to Cas9 are shown in bold and underlines (SEQ ID NO: 66)

```
MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

EIRLEESFLVEEDKKHERHPIFGNIVDEVAYHEKYPTIYHLRKKLVDST

DKADLRLIYLALAHMIKFRGHFLIEGDLNPDNSDVDKLFIQLVQTYNQL

FEENPINASGVDAKAILSARLSKSRRLENLIAQLPGEKKNGLFGNLIAL

SLGLTPNFKSNFDLAEDAKLQLSKDTYDDDLDNLLAQIGDQYADLFLAA
```

-continued

```
KNLSDAILLSDILRVNTEITKAPLSASMIKRYDEHHQDLTLLKALVRQQ

LPEKYKEIFFDQSKNGYAGYIDGGASQEEFYKFIKPILEKMDGTEELLV

KLNREDLLRKQRTEDNGSIPHQIHLGELHAILRRQEDFYPFLKDNREKI

EKILTFRIPYYVGPLARGNSRFAWMTRKSEETITPWNFEEVVDKGASAQ

SFIERMTAFDKNLPNEKVLPKHSLLYEYFTVYNELTKVKYVTEGMRKPA

FLSGEQKKAIVDLLEKTNRKVTVKQLKEDYFKKIECEDSVETSGVEDRF

NASLGTYHDLLKIIKDKDFLDNEENEDILEDIVLTLTLFEDREMIEERL

KTYAHLFDDKVMKQLKRRRYTGWGALSRKLINGIRDKQSGKTILDFLKS

DGFANRNFMALIHDDSLTFKEDIQKAQVSGQGDSLHEHIANLAGSPAIK

KGILQTVKVVDELVKVMGRHKPENIVIEMARENQTTQKGQKNSRERMKR

IEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKN

YWRQLLNAKLITQRKFDNLTKAERGGLSELDKAGFIKRQLVETRAITKH

VAQILDSRMNTKYDENDKLIREVKVITLKSKLVSDFRKDFQFYKVREIN

NYHHAHDAYLNAVVGTALIKKYPKLESEFVYGDYKVYDVRKMIAKSEQE

IGKATAKYFFYSNIMNFEKTEITLANGEIRKRPLIETNGETGEIVWDKG

RDFATVRKVLSMPQVNIVKKTEVQTGGFSKESILPKRNSDKLIARKKDW

DPKKYGGFDSPTVAYSVLVVAKVEKGKSKKLKSVKELLGITIMERSSFE

KNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQI

SEFSKRVILADANLDKVLSAYNKHRDKPIREQAENIIHLFTLTNLGAPA

AFKYFDTTIDRKRYTSTKEVLDATLIHQSITGLYETRIDLSQLGGD
```

Guide Polynucleotides

As used herein, the term "guide polynucleotide(s)" refer to a polynucleotide which can be specific for a target sequence and can form a complex with a polynucleotide programmable nucleotide binding domain protein (e.g., Cas9 or Cpf1). In an embodiment, the guide polynucleotide is a guide RNA. As used herein, the term "guide RNA (gRNA)" and its grammatical equivalents can refer to an RNA which can be specific for a target DNA and can form a complex with Cas protein. An RNA/Cas complex can assist in "guiding" Cas protein to a target DNA. Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA" or simply "gRNA") can be engineered so as to incorporate aspects of both the crRNA and tracrRNA into a single RNA species. See, e.g., Jinek M. et al., Science 337:816-821 (2012), the entire contents of which is hereby incorporated by reference. Cas9 recognizes a short motif in the CRISPR repeat sequences (the PAM or protospacer adjacent motif) to help distinguish self versus non-self Cas9 nuclease sequences and structures are well known to those of skill in the art (see e.g., "Complete genome sequence of an M1 strain of *Streptococcus pyogenes*." Ferretti, J. J. et al., Natl. Acad. Sci. U.S.A. 98:4658-4663(2001); "CRISPR RNA maturation by trans-encoded small RNA and host factor RNase III." Deltcheva E. et al., Nature 471:602-607(2011);

and "Programmable dual-RNA-guided DNA endonuclease in adaptive bacterial immunity." Jinek M. et al, Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences can be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

In some embodiments, the guide polynucleotide is at least one single guide RNA ("sgRNA" or "gNRA"). In some embodiments, the guide polynucleotide is at least one tracrRNA. In some embodiments, the guide polynucleotide does not require PAM sequence to guide the polynucleotide-programmable DNA-binding domain (e.g., Cas9 or Cpf1) to the target nucleotide sequence.

The polynucleotide programmable nucleotide binding domain (e.g., a CRISPR-derived domain) of the base editors disclosed herein can recognize a target polynucleotide sequence by associating with a guide polynucleotide. A guide polynucleotide (e.g., gRNA) is typically single-stranded and can be programmed to site-specifically bind (i.e., via complementary base pairing) to a target sequence of a polynucleotide, thereby directing a base editor that is in conjunction with the guide nucleic acid to the target sequence. A guide polynucleotide can be DNA. A guide polynucleotide can be RNA. In some cases, the guide polynucleotide comprises natural nucleotides (e.g., adenosine). In some cases, the guide polynucleotide comprises non-natural (or unnatural) nucleotides (e.g., peptide nucleic acid or nucleotide analogs). In some cases, the targeting region of a guide nucleic acid sequence can be at least 15, 16, 17, 18, 19, 20, 21, 22, 23, 24, 25, 26, 27, 28, 29, or 30 nucleotides in length. A targeting region of a guide nucleic acid can be between 10-30 nucleotides in length, or between 15-25 nucleotides in length, or between 15-20 nucleotides in length.

In some embodiments, a guide polynucleotide comprises two or more individual polynucleotides, which can interact with one another via for example complementary base pairing (e.g. a dual guide polynucleotide). For example, a guide polynucleotide can comprise a CRISPR RNA (crRNA) and a trans-activating CRISPR RNA (tracrRNA). For example, a guide polynucleotide can comprise one or more trans-activating CRISPR RNA (tracrRNA).

In type II CRISPR systems, targeting of a nucleic acid by a CRISPR protein (e.g. Cas9) typically requires complementary base pairing between a first RNA molecule (crRNA) comprising a sequence that recognizes the target sequence and a second RNA molecule (trRNA) comprising repeat sequences which forms a scaffold region that stabilizes the guide RNA-CRISPR protein complex. Such dual guide RNA systems can be employed as a guide polynucleotide to direct the base editors disclosed herein to a target polynucleotide sequence.

In some embodiments, the base editor provided herein utilizes a single guide polynucleotide (e.g., gRNA). In some embodiments, the base editor provided herein utilizes a dual guide polynucleotide (e.g., dual gRNAs). In some embodiments, the base editor provided herein utilizes one or more guide polynucleotide (e.g., multiple gRNA). In some embodiments, a single guide polynucleotide is utilized for different base editors described herein. For example, a single guide polynucleotide can be utilized for a cytidine base editor and an adenosine base editor.

In other embodiments, a guide polynucleotide can comprise both the polynucleotide targeting portion of the nucleic acid and the scaffold portion of the nucleic acid in a single molecule (i.e., a single-molecule guide nucleic acid). For example, a single-molecule guide polynucleotide can be a single guide RNA (sgRNA or gRNA). Herein the term guide polynucleotide sequence contemplates any single, dual or multi-molecule nucleic acid capable of interacting with and directing a base editor to a target polynucleotide sequence.

Typically, a guide polynucleotide (e.g., crRNA/trRNA complex or a gRNA) comprises a "polynucleotide-targeting segment" that includes a sequence capable of recognizing and binding to a target polynucleotide sequence, and a "protein-binding segment" that stabilizes the guide polynucleotide within a polynucleotide programmable nucleotide binding domain component of a base editor. In some embodiments, the polynucleotide targeting segment of the guide polynucleotide recognizes and binds to a DNA polynucleotide, thereby facilitating the editing of a base in DNA. In other cases, the polynucleotide targeting segment of the guide polynucleotide recognizes and binds to an RNA polynucleotide, thereby facilitating the editing of a base in RNA. Herein a "segment" refers to a section or region of a molecule, e.g., a contiguous stretch of nucleotides in the guide polynucleotide. A segment can also refer to a region/section of a complex such that a segment can comprise regions of more than one molecule. For example, where a guide polynucleotide comprises multiple nucleic acid molecules, the protein-binding segment of can include all or a portion of multiple separate molecules that are for instance hybridized along a region of complementarity. In some embodiments, a protein-binding segment of a DNA-targeting RNA that comprises two separate molecules can comprise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and can include regions of RNA molecules that are of any total length and can include regions with complementarity to other molecules.

A guide RNA or a guide polynucleotide can comprise two or more RNAs, e.g., CRISPR RNA (crRNA) and transactivating crRNA (tracrRNA). A guide RNA or a guide polynucleotide can sometimes comprise a single-chain RNA, or single guide RNA (sgRNA) formed by fusion of a portion (e.g., a functional portion) of crRNA and tracrRNA. A guide RNA or a guide polynucleotide can also be a dual RNA comprising a crRNA and a tracrRNA. Furthermore, a crRNA can hybridize with a target DNA.

As discussed above, a guide RNA or a guide polynucleotide can be an expression product. For example, a DNA that encodes a guide RNA can be a vector comprising a sequence coding for the guide RNA. A guide RNA or a guide polynucleotide can be transferred into a cell by transfecting the cell with an isolated guide RNA or plasmid DNA comprising a sequence coding for the guide RNA and a promoter. A guide RNA or a guide polynucleotide can also be transferred into a cell in other way, such as using virus-mediated gene delivery.

A guide RNA or a guide polynucleotide can be isolated. For example, a guide RNA can be transfected in the form of an isolated RNA into a cell or organism. A guide RNA can be prepared by in vitro transcription using any in vitro transcription system known in the art. A guide RNA can be transferred to a cell in the form of isolated RNA rather than in the form of plasmid comprising encoding sequence for a guide RNA.

A guide RNA or a guide polynucleotide can comprise three regions: a first region at the 5' end that can be complementary to a target site in a chromosomal sequence, a second internal region that can form a stem loop structure, and a third 3' region that can be single-stranded. A first region of each guide RNA can also be different such that each guide RNA guides a fusion protein to a specific target site. Further, second and third regions of each guide RNA can be identical in all guide RNAs.

A first region of a guide RNA or a guide polynucleotide can be complementary to sequence at a target site in a chromosomal sequence such that the first region of the guide RNA can base pair with the target site. In some cases, a first region of a guide RNA can comprise from or from about 10 nucleotides to 25 nucleotides (i.e., from 10 nucleotides to 25 nucleotides; or from about 10 nucleotides to about 25 nucleotides; or from 10 nucleotides to about 25 nucleotides; or from about 10 nucleotides to 25 nucleotides) or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more nucleotides in length. Sometimes, a first region of a guide RNA can be or can be about 19, 20, or 21 nucleotides in length.

A guide RNA or a guide polynucleotide can also comprise a second region that forms a secondary structure. For example, a secondary structure formed by a guide RNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A guide RNA or a guide polynucleotide can also comprise a third region at the 3' end that can be essentially single-stranded. For example, a third region is sometimes not complementarity to any chromosomal sequence in a cell of interest and is sometimes not complementarity to the rest of a guide RNA. Further, the length of a third region can vary. A third region can be more than or more than about 4 nucleotides in length. For example, the length of a third region can range from or from about 5 to 60 nucleotides in length.

A guide RNA or a guide polynucleotide can target any exon or intron of a gene target. In some cases, a guide can target exon 1 or 2 of a gene, in other cases; a guide can target exon 3 or 4 of a gene. A composition can comprise multiple guide RNAs that all target the same exon or in some cases, multiple guide RNAs that can target different exons. An exon and an intron of a gene can be targeted.

A guide RNA or a guide polynucleotide can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30, or anywhere between 1-100 nucleotides in length. A target nucleic acid can be at most or at most about 5, 10, 15, 16, 17, 18, 19, 20, 21, 22, 23, 24, 25, 30, 40, 50, or anywhere between 1-100 nucleotides in length. A target nucleic acid sequence can be or can be about 20 bases immediately 5' of the first nucleotide of the PAM. A guide RNA can target a nucleic acid sequence. A target nucleic acid can be at least or at least about 1-10, 1-20, 1-30, 1-40, 1-50, 1-60, 1-70, 1-80, 1-90, or 1-100 nucleotides.

A guide polynucleotide, for example, a guide RNA, can refer to a nucleic acid that can hybridize to another nucleic acid, for example, the target nucleic acid or protospacer in a genome of a cell. A guide polynucleotide can be RNA. A guide polynucleotide can be DNA. The guide polynucleotide can be programmed or designed to bind to a sequence of nucleic acid site-specifically. A guide polynucleotide can comprise a polynucleotide chain and can be called a single guide polynucleotide. A guide polynucleotide can comprise two polynucleotide chains and can be called a double guide polynucleotide. A guide RNA can be introduced into a cell or embryo as an RNA molecule. For example, a RNA molecule can be transcribed in vitro and/or can be chemically synthesized. An RNA can be transcribed from a synthetic DNA molecule, e.g., a GBLOCKS® gene fragment. A guide RNA can then be introduced into a cell or embryo as an RNA molecule. A guide RNA can also be introduced into a cell or embryo in the form of anon-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III). Plasmid vectors that can be used to express guide RNA include, but are not limited to, px330 vectors and px333 vectors. In some cases, a plasmid vector (e.g., px333 vector) can comprise at least two guide RNA-encoding DNA sequences.

Methods for selecting, designing, and validating guide polynucleotides, e.g. guide RNAs and targeting sequences are described herein and known to those skilled in the art. For example, to minimize the impact of potential substrate promiscuity of a deaminase domain in the nucleobase editor system (e.g., an AID domain), the number of residues that could unintentionally be targeted for deamination (e.g., off-target C residues that could potentially reside on ssDNA within the target nucleic acid locus) may be minimized. In addition, software tools can be used to optimize the gRNAs corresponding to a target nucleic acid sequence, e.g., to minimize total off-target activity across the genome. For example, for each possible targeting domain choice using *S. pyogenes* Cas9, all off-target sequences (preceding selected PAMs, e.g. NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g. crRNAs) can be ranked according to its total predicted off-target score; the top-ranked targeting domains represent those that are likely to have the greatest on-target and the least off-target activity. Candidate targeting gRNAs can be functionally evaluated by using methods known in the art and/or as set forth herein.

As a non-limiting example, target DNA hybridizing sequences in crRNAs of a guide RNA for use with Cas9s may be identified using a DNA sequence searching algorithm. gRNA design may be carried out using custom gRNA design software based on the public tool cas-offinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014). This software scores guides after calculating their genome-wide off-target propensity. Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a target nucleic acid sequence, e.g. a target gene may be obtained and repeat elements may be screened using publically available tools, for example, the RepeatMasker program. RepeatMasker searches input DNA sequences for repeated elements and regions of low complexity. The output is a detailed annotation of the repeats present in a given query sequence.

Following identification, first regions of guide RNAs, e.g. crRNAs, may be ranked into tiers based on their distance to the target site, their orthogonality and presence of 5' nucleotides for close matches with relevant PAM sequences (for example, a 5' G based on identification of close matches in the human genome containing a relevant PAM e.g., NGG PAM for *S. pyogenes*, NNGRRT or NNGRRV PAM for *S. aureus*). As used herein, orthogonality refers to the number of sequences in the human genome that contain a minimum number of mismatches to the target sequence. A "high level of orthogonality" or "good orthogonality" may, for example, refer to 20-mer targeting domains that have no identical sequences in the human genome besides the intended target, nor any sequences that contain one or two mismatches in the target sequence. Targeting domains with good orthogonality may be selected to minimize off-target DNA cleavage.

In some embodiments, a reporter system may be used for detecting base-editing activity and testing candidate guide polynucleotides. In some embodiments, a reporter system may comprise a reporter gene based assay where base editing activity leads to expression of the reporter gene. For example, a reporter system may include a reporter gene comprising a deactivated start codon, e.g., a mutation on the template strand from 3'-TAC-5' to 3'-CAC-5'. Upon successful deamination of the target C, the corresponding mRNA will be transcribed as 5'-AUG-3' instead of 5'-GUG-3', enabling the translation of the reporter gene. Suitable reporter genes will be apparent to those of skill in the art. Non-limiting examples of reporter genes include gene encoding green fluorescence protein (GFP), red fluorescence protein (RFP), luciferase, secreted alkaline phosphatase (SEAP), or any other gene whose expression are detectable and apparent to those skilled in the art. The reporter system can be used to test many different gRNAs, e.g., in order to determine which residue(s) with respect to the target DNA sequence the respective deaminase will target. sgRNAs that target non-template strand can also be tested in order to assess off-target effects of a specific base editing protein, e.g. a Cas9 deaminase fusion protein. In some embodiments, such gRNAs can be designed such that the mutated start codon will not be base-paired with the gRNA. The guide polynucleotides can comprise standard ribonucleotides, modified ribonucleotides (e.g., pseudouridine), ribonucleotide isomers, and/or ribonucleotide analogs. In some embodiments, the guide polynucleotide can comprise at least one detectable label. The detectable label can be a fluorophore (e.g., FAM, TMR, Cy3, Cy5, Texas Red, Oregon Green, Alexa Fluors, Halo tags, or suitable fluorescent dye), a detection tag (e.g., biotin, digoxigenin, and the like), quantum dots, or gold particles.

The guide polynucleotides can be synthesized chemically, synthesized enzymatically, or a combination thereof. For example, the guide RNA can be synthesized using standard phosphoramidite-based solid-phase synthesis methods. Alternatively, the guide RNA can be synthesized in vitro by operably linking DNA encoding the guide RNA to a promoter control sequence that is recognized by a phage RNA polymerase. Examples of suitable phage promoter sequences include T7, T3, SP6 promoter sequences, or variations thereof. In embodiments in which the guide RNA comprises two separate molecules (e.g., crRNA and tracrRNA), the crRNA can be chemically synthesized and the tracrRNA can be enzymatically synthesized.

In some embodiments, a base editor system may comprise multiple guide polynucleotides, e.g. gRNAs. For example, the gRNAs may target to one or more target loci (e.g., at least 1 gRNA, at least 2 gRNA, at least 5 gRNA, at least 10 gRNA, at least 20 gRNA, at least 30 g RNA, at least 50 gRNA) comprised in a base editor system. Said multiple gRNA sequences can be tandemly arranged and are preferably separated by a direct repeat.

A DNA sequence encoding a guide RNA or a guide polynucleotide can also be part of a vector. Further, a vector can comprise additional expression control sequences (e.g., enhancer sequences, Kozak sequences, polyadenylation sequences, transcriptional termination sequences, etc.), selectable marker sequences (e.g., GFP or antibiotic resistance genes such as puromycin), origins of replication, and the like. A DNA molecule encoding a guide RNA can also be linear. A DNA molecule encoding a guide RNA or a guide polynucleotide can also be circular.

In some embodiments, one or more components of a base editor system may be encoded by DNA sequences. Such DNA sequences may be introduced into an expression system, e.g. a cell, together or separately. For example, DNA sequences encoding a polynucleotide programmable nucleotide binding domain and a guide RNA may be introduced into a cell, each DNA sequence can be part of a separate molecule (e.g., one vector containing the polynucleotide programmable nucleotide binding domain coding sequence and a second vector containing the guide RNA coding sequence) or both can be part of a same molecule (e.g., one vector containing coding (and regulatory) sequence for both the polynucleotide programmable nucleotide binding domain and the guide RNA).

A guide polynucleotide can comprise one or more modifications to provide a nucleic acid with anew or enhanced feature. A guide polynucleotide can comprise a nucleic acid affinity tag. A guide polynucleotide can comprise synthetic nucleotide, synthetic nucleotide analog, nucleotide derivatives, and/or modified nucleotides.

In some cases, a gRNA or a guide polynucleotide can comprise modifications. A modification can be made at any location of a gRNA or a guide polynucleotide. More than one modification can be made to a single gRNA or a guide polynucleotide. A gRNA or a guide polynucleotide can undergo quality control after a modification. In some cases, quality control can include PAGE, HPLC, MS, or any combination thereof.

A modification of a gRNA or a guide polynucleotide can be a substitution, insertion, deletion, chemical modification, physical modification, stabilization, purification, or any combination thereof.

A gRNA or a guide polynucleotide can also be modified by 5'adenylate, 5'guanosine-triphosphate cap, 5'N7-Methyl-guanosine-triphosphate cap, 5'triphosphate cap, 3'phosphate, 3'thiophosphate, 5'phosphate, 5'thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2'-deoxyribonucleoside analog purine, 2'-deoxyribonucleoside analog pyrimidine, ribonucleoside analog, 2'-O-methyl ribonucleoside analog, sugar modified analogs, wobble/universal bases, fluorescent dye label, 2'-fluoro RNA, 2'-O-methyl RNA, methylphosphonate, phosphodiester DNA, phosphodiester RNA, phosphothioate DNA, phosphorothioate RNA, UNA, pseudouridine-5'-triphosphate, 5'-methylcytidine-5'-triphosphate, or any combination thereof.

In some cases, a modification is permanent. In other cases, a modification is transient. In some cases, multiple modifications are made to a gRNA or a guide polynucleotide. A gRNA or a guide polynucleotide modification can alter physiochemical properties of a nucleotide, such as their conformation, polarity, hydrophobicity, chemical reactivity, base-pairing interactions, or any combination thereof.

A modification can also be a phosphorothioate substitute. In some cases, a natural phosphodiester bond can be susceptible to rapid degradation by cellular nucleases and; a modification of internucleotide linkage using phosphorothioate (PS) bond substitutes can be more stable towards hydrolysis by cellular degradation. A modification can increase stability in a gRNA or a guide polynucleotide. A modification can also enhance biological activity. In some cases, a phosphorothioate enhanced RNA gRNA can inhibit RNase A, RNase T1, calf serum nucleases, or any combinations thereof. These properties can allow the use of PS-RNA gRNAs to be used in applications where exposure to nucleases is of high probability in vivo or in vitro. For example, phosphorothioate (PS) bonds can be introduced between the last 3-5 nucleotides at the 5'- or ‘'-end of a gRNA which can inhibit exonuclease degradation. In some cases, phosphorothioate bonds can be added throughout an entire gRNA to reduce attack by endonucleases.

Protospacer Adjacent Motif

The term “protospacer adjacent motif (PAM)”)” or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The protospacer adjacent motif (PAM) or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer). The PAM sequence is essential for target binding, but the exact sequence depends on a type of Cas protein.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities. For example, typically Cas9 proteins, such as Cas9 from *S. pyogenes* (spCas9), require a canonical NGG PAM sequence to bind a particular nucleic acid region, where the “N” in “NGG” is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1 135E, R1335Q, and T1337R mutation, or a corresponding mutation in any of the amino acid sequences provided herein. In some embodiments, the SpCas9 domain comprises a D1 135E, a R1335Q, and a T1337R mutation, or corresponding mutations in any of the amino acid sequences provided herein. In some embodiments, the SpCas9 domain comprises one or more of a D1 135X, a R1335X, and a T1337X mutation, or a corresponding mutation in any of the amino acid sequences provided herein, wherein X is any amino acid. In some embodiments, the SpCas9 domain comprises one or more of a D1135V, a R1335Q, and a T1337R mutation, or a corresponding mutation in any of the amino acid sequences provided herein. In some embodiments, the SpCas9 domain comprises a D1 135V, a R1335Q, and a T1337R mutation, or corresponding mutations in any of the amino acid sequences provided herein. In some embodiments, the SpCas9 domain comprises one or more of a D1 135X, a G1218X, a R1335X, and a T1337X mutation, or a corresponding mutation in any of the amino acid sequences provided herein, wherein X is any amino acid. In some embodiments, the SpCas9 domain comprises one or more of a D1 135V, a G1218R, a R1335Q, and a T1337R mutation, or a corresponding mutation in any of the amino acid sequences provided herein. In some embodiments, the SpCas9. In some embodiments, the SpCas9 domain comprises a D1 135V, a G1218R, a R1335Q, and a T1337R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

The sequences of exemplary SpCas9 proteins capable of binding a PAM sequence follow:

Exemplary SpCas9
(SEQ ID NO: 67)
MDKKYSIGLDIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVETSGVEDRFN
ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITQRKFDNLTKAERGGLSELDKAGFIKRQLVETRQITKHV
AQILDSRMNTKYDENDKLIREVKVITLKSKLVSDFRKDFQFYKVREINN
YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS -continued EFSKRVILADANLDKVLSAYNKHRDKPIREQAENIIHLFTLTNLGAPAA
FKYFDTTIDRKRYTSTKEVLDATLIHQSITGLYETRIDLSQLGGD Exemplary SpCas9n
(SEQ ID NO: 68)
MDKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITQRKFDNLTKAERGGLSELDKAGFIKRQLVETRQITKHV
AQILDSRMNTKYDENDKLIREVKVITLKSKLVSDFRKDFQFYKVREINN
YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA
FKYFDTTIDRKRYTSTKEVLDATLIHQSITGLYETRIDLSQLGGD Exemplary SpEQR Cas9
(SEQ ID NO: 69)
MDKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVETSGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFESPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKQYRSTKEVLDATLIHQSITGLYETRIDLSQLGGD

Residues E1135, Q1335, and R1337 above, which can be mutated from D1135, R1335, and T1337 to yield a SpEQR Cas9, are underlined and in bold.

Exemplary SpVQR Cas9

(SEQ ID NO: 70)

MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVETSGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFVSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKQYRSTKEVLDATLIHQSITGLYETRIDLSQLGGD

Residues V1135, Q1335, and R1337 above, which can be mutated from D1135, R1335, and T1337 to yield a SpVQR Cas9, are underlined and in bold.

Exemplary SpVRER Cas 9

(SEQ ID NO: 71)

MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVETSGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFVSPTVAYSVLVVAKVEKGKSKKLKSVKELLGITIMERSSFEK

NPIDFLEAKGYKEVKKDLIIKLPKYSLFELENGRKRMLASARELQKGNE

LALPSKYVNFLYLASHYEKLKGSPEDNEQKQLFVEQHKHYLDEIIEQIS

-continued

EFSKRVILADANLDKVLSAYNKHRDKPIREQAENIIHLFTLTNLGAPAA

FKYFDTTIDRKEYRSTKEVLDATLIHQSITGLYETRIDLSQLGGD.

Exemplary SpVRQR Cas9

(SEQ ID NO: 72)

MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVETSGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFVSPTVAYSVLVVAKVEKGKSKKLKSVKELLGITIMERSSFEK

NPIDFLEAKGYKEVKKDLIIKLPKYSLFELENGRKRMLASARELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKQYRSTKEVLDATLIHQSITGLYETRIDLSQLGGD.

Residues V1135, R1218, Q1335, and R1337 above, which can be mutated from D1135, G1218, R1335, and T1337 to yield a SpVRQR Cas9, are underlined and in bold.

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a SpyMacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMacCas9 domain, the SpCas9d domain, or the SpCas9n domain can bind to a nucleic acid sequence having a NAA PAM sequence.

Exemplary SpyMacCas9

(SEQ ID NO: 73)

MDKKYSIGLDIGTNSVGWAVITDDYKVPSKKFKVLGNTDRHSIKKNLIG

ALLFGSGETAEATRLKRTARRRYTRRKNRICYLQEIFSNEMAKVDDSFE

HRLEESELVEEDKKHERHPIFGNIVDEVAYHEKYPTIYHLRKKLADSTD

KADLRLIYLALAHMIKFRGHFLIEGDLNPDNSDVDKLFIQLVQIYNQLF

EENPINASRVDAKAILSARLSKSRRLENLIAQLPGEKRNGLFGNLIALS

LGLTPNFKSNFDLAEDAKLQLSKDTYDDDLDNLLAQIGDQYADLFLAAK

NLSDAILLSDILRVNSEITKAPLSASMIKRYDEHHQDLTLLKALVRQQL

PEKYKEIFFDQSKNGYAGYIDGGASQEEFYKFIKPILEKMDGTEELLVK

LNREDLLRKQRTEDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGAYHDLLKIIKDKDFLDNEENEDILEDIVLTLTLFEDRGMIEERLK

TYAHLFDDKVMKQLKRRRYTGWGRLSRKLINGIRDKQSGKTILDFLKSD

GFANRNFMQLIHDDSLTFKEDIQKAQVSGQGHSLHEQIANLAGSPAIKK

GILQTVKIVDELVKVMGHKPENIVIEMARENQTTQKGQKNSRERMKRIE

EGIKELGSQILKEHPVENTQLQNEKLYLYYLQNGRDMYVDQELDINRLS

DYDVDHIVPQSFIKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEIQTVGQNGGLFDDNPKSPLEVTPSKLVPL

KKELNPKKYGGYQKPTTAYPVLLITDTKQLIPISVMNKKQFEQNPVKFL

RDRGYQQVGKNDFIKLPKYTLVDIGDGIKRLWASSKEIHKGNQLVVSKK

SQILLYHAHHLDSDLSNDYLQNHNQQEDVLENEIISFSKKCKLGKEHIQ

KIENVYSNKKNSASIEELAESFIKLLGFTQLGATSPFNFLGVKLNQKQY

KGKKDYILPCTEGTLIRQSITGLYETRVDLSKIGED.

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

High Fidelity Cas9 domain mutations relative to Cas9 are shown in bold and underline (SEQ ID NO: 74)

MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFE

HRLEESELVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTEDNGSIPHQIHLGELHAILRRQEDFYPFLKDNREKIE

KILTFRIPYYVGPLARGNSRFAWMTRKSEETITPWNFEEVVDKGASAQS

FIERMTAFDKNLPNEKVLPKHSLLYEYFTVYNELTKVKYVTEGMRKPAF

LSGEQKKAIVDLLFKTNRKVTVKQLKEDYFKKIECFDSVETSGVEDRFN

ASLGTYHDLLKIIKDKDFLDNEENEDILEDIVLTLTLFEDREMIEERLK

TYAHLFDDKVMKQLKRRRYTGWGALSRKLINGIRDKQSGKTILDFLKSD

GFANRNFMALIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRAITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

-continued

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD.

In some cases, a variant Cas9 protein harbors, H840A, P475A, W476A, N477A, D1 125A, W1126A, and D1 127A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1 125A, W1126A, and D1 127A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference.

In some examples, a PAM recognized by a CRISPR protein-derived domain of a base editor disclosed herein can be provided to a cell on a separate oligonucleotide to an insert (e.g. an AAV insert) encoding the base editor. In such cases, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some cases, a different endonuclease can be used to target certain genomic targets. In some cases, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4kb coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some cases, a Cas protein can target a different PAM sequence. In some cases, a target gene can be adjacent to a Cas9 PAM, 5'-NGG, for example. In other cases, other Cas9 orthologs can have different PAM requirements. For example, other PAMs such as those of *S. thermophilus* (5'-NNAGAA for CRISPR1 and 5'-NGGNG for CRISPR3) and *Neisseria meningiditis* (5'-NNNNGATT) can also be found adjacent to a target gene.

In some embodiments, for a *S. pyogenes* system, a target gene sequence can precede (i.e., be 5' to) a 5'-NGG PAM, and a 20-nt guide RNA sequence can base pair with an opposite strand to mediate a Cas9 cleavage adjacent to a PAM. In some cases, an adjacent cut can be or can be about 3 base pairs upstream of a PAM. In some cases, an adjacent cut can be or can be about 10 base pairs upstream of a PAM. In some cases, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs.

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFES PKKKRKV (SEQ ID NO: 75), KRTADGSEFESPKKKRKV (SEQ ID NO: 30), KRPAATKKAGQAKKKK (SEQ ID NO: 31), KKTELQTTNAENKTKKL (SEQ ID NO: 32), KRGINDRNFWRGENGRKTR (SEQ ID NO: 33), RKSGKIAAIVVKRPRKPKKKRKV (SEQ ID NO: 171), or MDSLLMNRRKFLYQFKNVRWAKGRRETYLC (SEQ ID NO: 36). In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 76), is the prototype of the ubiquitous bipartite signal: two clusters of basic amino acids, separated by a spacer of about 10 amino acids. The sequence of an exemplary bipartite NLS follows: PKKKRKVEGADKRTADGSEFES PKKKRKV (SEQ ID NO: 75).

In some embodiments, the fusion proteins of the invention do not comprise a linker sequence. In some embodiments, linker sequences between one or more of the domains or proteins are present.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the ammo-terminus, about or more than about 1, 2, 3, 4, 5, 6, 7, 8, 9, 10 NLSs at or near the carboxy-terminus, or any combination of these (e.g., one or more NLS at the ammo-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise about 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

The PAM sequence can be any PAM sequence known in the art. Suitable PAM sequences include, but are not limited to, NGG, NGA, NGC, NGN, NGT, NGCG, NGAG, NGAN, NGNG, NGCN, NGCG, NGTN, NNGRRT, NNNRRT, NNGRR(N), TTTV, TYCV, TYCV, TATV, NNNNGATT, NNAGAAW, or NAAAAC. Y is a pyrimidine; N is any nucleotide base; W is A or T.

Cas9 Domains with Reduced Exclusivity

Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); Nishimasu, H., et al., "Engineered CRISPR-Cas9 nuclease with expanded targeting space" Science. 2018 Sep. 21; 361(6408):1259-1262, Chatterjee, P., et al., Minimal PAM specificity of a highly similar SpCas9 ortholog" Sci Adv. 2018 Oct. 24; 4(10):eaau0766. doi: 10.1126/sciadv.aau0766, the entire contents of each are hereby incorporated by reference. Several PAM variants are described in Table 1 below.

TABLE 1

Cas9 proteins and corresponding PAM sequences

| Variant | PAM |
|---|---|
| spCas9 | NGG |
| spCas9-VRQR | NGA |
| spCas9-VRER | NGCG |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| SpyMacCas9 | NAA |
| Cpf1 | 5' (TTTV) |

Nucleobase Editing Domain

Described herein are base editors comprising a fusion protein that includes a polynucleotide programmable nucleotide binding domain and a nucleobase editing domain (e.g., deaminase domain). The base editor can be programmed to edit one or more bases in a target polynucleotide sequence by interacting with a guide polynucleotide capable of recognizing the target sequence. Once the target sequence has been recognized, the base editor is anchored on the polynucleotide where editing is to occur and the deaminase domain component of the base editor can then edit a target base.

In some embodiments, the nucleobase editing domain is a deaminase domain. In some cases, a deaminase domain can be a cytosine deaminase or a cytidine deaminase. In some embodiments, the terms "cytosine deaminase" and "cytidine deaminase" can be used interchangeably. In some cases, a deaminase domain can be an adenine deaminase or an adenosine deaminase. In some embodiments, the terms "adenine deaminase" and "adenosine deaminase" can be used interchangeably. Details of nucleobase editing proteins are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

C to T Editing

In some embodiments, a base editor disclosed herein comprises a fusion protein comprising cytidine deaminase capable of deaminating a target cytidine (C) base of a polynucleotide to produce uridine (U), which has the base pairing properties of thymine. In some embodiments, for example where the polynucleotide is double-stranded (e.g. DNA), the uridine base can then be substituted with a thymidine base (e.g. by cellular repair machinery) to give rise to a C:G to a T:A transition. In other embodiments, deamination of a C to U in a nucleic acid by a base editor cannot be accompanied by substitution of the U to a T.

The deamination of a target C in a polynucleotide to give rise to a U is a non-limiting example of a type of base editing that can be executed by a base editor described herein. In another example, a base editor comprising a cytidine deaminase domain can mediate conversion of a cytosine (C) base to a guanine (G) base. For example, a U of a polynucleotide produced by deamination of a cytidine by a cytidine deaminase domain of a base editor can be excised from the polynucleotide by a base excision repair mechanism (e.g., by a uracil DNA glycosylase (UDG) domain), producing an abasic site. The nucleobase opposite the abasic site can then be substituted (e.g. by base repair machinery) with another base, such as a C, by for example a translesion polymerase. Although it is typical for a nucleobase opposite an abasic site to be replaced with a C, other substitutions (e.g. A, G or T) can also occur.

Accordingly, in some embodiments a base editor described herein comprises a deamination domain (e.g., cytidine deaminase domain) capable of deaminating a target C to a U in a polynucleotide. Further, as described below, the base editor can comprise additional domains which facilitate conversion of the U resulting from deamination to, in some embodiments, a T or a G. For example, a base editor comprising a cytidine deaminase domain can further comprise a uracil glycosylase inhibitor (UGI) domain to mediate substitution of a U by a T, completing a C-to-T base editing event. In another example, a base editor can incorporate a translesion polymerase to improve the efficiency of C-to-G base editing, since a translesion polymerase can facilitate incorporation of a C opposite an abasic site (i.e., resulting in incorporation of a G at the abasic site, completing the C-to-G base editing event).

A base editor comprising a cytidine deaminase as a domain can deaminate a target C in any polynucleotide, including DNA, RNA and DNA-RNA hybrids. Typically, a cytidine deaminase catalyzes a C nucleobase that is positioned in the context of a single-stranded portion of a polynucleotide. In some embodiments, the entire polynucleotide comprising a target C can be single-stranded. For example, a cytidine deaminase incorporated into the base editor can deaminate a target C in a single-stranded RNA polynucleotide. In other embodiments, a base editor comprising a cytidine deaminase domain can act on a double-stranded polynucleotide, but the target C can be positioned in a portion of the polynucleotide which at the time of the deamination reaction is in a single-stranded state. For example, in embodiments where the NAGPB domain comprises a Cas9 domain, several nucleotides can be left unpaired during formation of the Cas9-gRNA-target DNA complex, resulting in formation of a Cas9 "R-loop complex". These unpaired nucleotides can form a bubble of single-stranded DNA that can serve as a substrate for a single-strand specific nucleotide deaminase enzyme (e.g., cytidine deaminase).

In some embodiments, a cytidine deaminase of a base editor can comprise all or a portion of an apolipoprotein B mRNA editing complex (APOBEC) family deaminase. Apolipoprotein B mRNA editing enzyme, catalytic polypeptide-like (APOBEC) is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. A number of modified cytidine deaminases are commercially available, including but not limited to SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177). In some embodiments, a deaminase incorporated into a base editor comprises all or a portion of an APOBEC1 deaminase. In some embodiments, a deaminase incorporated into a base editor comprises all or a portion of APOBEC2 deaminase. In some embodiments, a deaminase incorporated into a base editor comprises all or a portion of is an APOBEC3 deaminase. In some embodiments, a deaminase incorporated into a base editor comprises all or a portion of an APOBEC3A deaminase. In some embodiments, a deaminase incorporated into a base editor comprises all or a portion of APOBEC3B deaminase. In some embodiments, a deaminase incorporated into a base editor comprises all or a portion of APOBEC3C deaminase. In some embodiments, a deaminase incorporated into a base editor comprises all or a portion of APOBEC3D deaminase. In some embodiments, a deaminase incorporated into a base editor comprises all or a portion of APOBEC3E deaminase. In some embodiments, a deaminase incorporated into a base editor comprises all or a portion of APOBEC3F deaminase. In some embodiments, a deaminase incorporated into a base editor comprises all or a portion of APOBEC3G deaminase. In some embodiments, a deaminase incorporated into a base editor comprises all or a portion of APOBEC3H deaminase. In some embodiments, a deaminase incorporated into a base editor comprises all or a portion of APOBEC4 deaminase. In some embodiments, a deaminase incorporated into a base editor comprises all or a portion of activation-induced deaminase (AID).

In some embodiments a deaminase incorporated into a base editor comprises all or a portion of cytidine deaminase 1 (CDA1). It will be appreciated that a base editor can comprise a deaminase from any suitable organism (e.g., a human or a rat). In some embodiments, a deaminase domain of a base editor is from a human, chimpanzee, gorilla, monkey, cow, dog, rat, or mouse. In some embodiments, the deaminase domain of the base editor is derived from rat (e.g., rat APOBEC1). In some embodiments, the deaminase domain of the base editor is human APOBECI. In some embodiments, the deaminase domain of the base editor is pmCDA1.

The base sequence and amino acid sequence of PmCDA1 and the base sequence and amino acid sequence of CDS of human AID are shown herein below.

>tr|A5H718|A5H718_PETMA Cytosine deaminase OS = *Petromyzon marinus*
OX = 7757 PE = 2 SV = 1

(SEQ ID NO: 77)

MTDAEYVRIHEKLDIYTFKKQFFNNKKSVSHRCYVLFELKRRGERRACFWGYAVNKPQSG

TERGIHAEIFSIRKVEEYLRDNPGQFTINWYSSWSPCADCAEKILEWYNQELRGNGHTLK

IWACKLYYEKNARNQIGLWNLRDNGVGLNVMVSEHYQCCRKIFIQSSHNQLNENRWLEKT

LKRAEKRRSELSIMIQVKILHTTKSPAV

>EF094822.1 *Petromyzon marinus* isolate PmCDA.21 cytosine deaminase mRNA,
complete cds (SEQ ID NO: 78)

TGACACGACACAGCCGTGTATATGAGGAAGGGTAGCTGGATGGGGGGGGGGGGAATACGTTCAGAGAGGA

CATTAGCGAGCGTCTTGTTGGTGGCCTTGAGTCTAGACACCTGCAGACATGACCGACGCTGAGTACGTGA

GAATCCATGAGAAGTTGGACATCTACACGTTTAAGAAACAGTTTTTCAACAACAAAAAATCCGTGTCGCA

TAGATGCTACGTTCTCTTTGAATTAAAACGACGGGGTGAACGTAGAGCGTGTTTTTGGGGCTATGCTGTG

AATAAACCACAGAGCGGGACAGAACGTGGAATTCACGCCGAAATCTTTAGCATTAGAAAAGTCGAAGAAT

-continued

ACCTGCGCGACAACCCCGGACAATTCACGATAAATTGGTACTCATCCTGGAGTCCTTGTGCAGATTGCGC

TGAAAAGATCTTAGAATGGTATAACCAGGAGCTGCGGGGGAACGGCCACACTTTGAAAATCTGGGCTTGC

AAACTCTATTACGAGAAAAATGCGAGGAATCAAATTGGGCTGTGGAACCTCAGAGATAACGGGGTTGGGT

TGAATGTAATGGTAAGTGAACACTACCAATGTTGCAGGAAAATATTCATCCAATCGTCGCACAATCAATT

GAATGAGAATAGATGGCTTGAGAAGACTTTGAAGCGAGCTGAAAAACGACGGAGCGAGTTGTCCATTATG

ATTCAGGTAAAAATACTCCACACCACTAAGAGTCCTGCTGTTTAAGAGGCTATGCGGATGGTTTTC

>tr|Q6QJ80|Q6QJ80_HUMAN Activation-induced cytidine deaminase OS = *Homo sapiens* OX = 9606 GN = AICDA PE = 2 SV = 1

(SEQ ID NO: 79)

MDSLLMNRRKFLYQFKNVRWAKGRRETYLCYVVKRRDSATSFSLDFGYLRNKNGCHVELL

FLRYISDWDLDPGRCYRVTWFTSWSPCYDCARHVADFLRGNPNLSLRIFTARLYFCEDRK

AEPEGLRRLHRAGVQIAIMTFKAPV

>NG_011588.1:5001-15681 *Homo sapiens* activation induced cytidine deaminase (AICDA), RefSeqGene (LRG 17) on chromosome 12

(SEQ ID NO: 80)

AGAGAACCATCATTAATTGAAGTGAGATTTTTCTGGCCTGAGACTTGCAGGGAGGCAAGAAGACACTCTG

GACACCACTATGGACAGGTAAAGAGGCAGTCTTCTCGTGGGTGATTGCACTGGCCTTCCTCTCAGAGCAA

ATCTGAGTAATGAGACTGGTAGCTATCCCTTTCTCTCATGTAACTGTCTGACTGATAAGATCAGCTTGAT

CAATATGCATATATATTTTTTGATCTGTCTCCTTTTCTTCTATTCAGATCTTATACGCTGTCAGCCCAAT

TCTTTCTGTTTCAGACTTCTCTTGATTTCCCTCTTTTTCATGTGGCAAAAGAAGTAGTGCGTACAATGTA

CTGATTCGTCCTGAGATTTGTACCATGGTTGAAACTAATTTATGGTAATAATATTAACATAGCAAATCTT

TAGAGACTCAAATCATGAAAAGGTAATAGCAGTACTGTACTAAAAACGGTAGTGCTAATTTTCGTAATAA

TTTTGTAAATATTCAACAGTAAAACAACTTGAAGACACACTTTCCTAGGGAGGCGTTACTGAAATAATTT

AGCTATAGTAAGAAAATTTGTAATTTTAGAAATGCCAAGCATTCTAAATTAATTGCTTGAAAGTCACTAT

GATTGTGTCCATTATAAGGAGACAAATTCATTCAAGCAAGTTATTTAATGTTAAAGGCCCAATTGTTAGG

CAGTTAATGGCACTTTTACTATTAACTAATCTTTCCATTTGTTCAGACGTAGCTTAACTTACCTCTTAGG

TGTGAATTTGGTTAAGGTCCTCATAATGTCTTTATGTGCAGTTTTTGATAGGTTATTGTCATAGAACTTA

TTCTATTCCTACATTTATGATTACTATGGATGTATGAGAATAACACCTAATCCTTATACTTTACCTCAAT

TTAACTCCTTTATAAAGAACTTACATTACAGAATAAAGATTTTTTAAAAATATATTTTTTTGTAGAGACA

GGGTCTTAGCCCAGCCGAGGCTGGTCTCTAAGTCCTGGCCCAAGCGATCCTCCTGCCTGGGCCTCCTAAA

GTGCTGGAATTATAGACATGAGCCATCACATCCAATATACAGAATAAAGATTTTTAATGGAGGATTTAAT

GTTCTTCAGAAAATTTTCTTGAGGTCAGACAATGTCAAATGTCTCCTCAGTTTACACTGAGATTTTGAAA

ACAAGTCTGAGCTATAGGTCCTTGTGAAGGGTCCATTGGAAATACTTGTTCAAAGTAAAATGGAAAGCAA

AGGTAAAATCAGCAGTTGAAATTCAGAGAAAGACAGAAAAGGAGAAAAGATGAAATTCAACAGGACAGAA

GGGAAATATATTATCATTAAGGAGGACAGTATCTGTAGAGCTCATTAGTGATGGCAAAATGACTTGGTCA

GGATTATTTTTAACCCGCTTGTTTCTGGTTTGCACGGCTGGGGATGCAGCTAGGGTTCTGCCTCAGGGAG

CACAGCTGTCCAGAGCAGCTGTCAGCCTGCAAGCCTGAAACACTCCCTCGGTAAAGTCCTTCCTACTCAG

GACAGAAATGACGAGAACAGGGAGCTGGAAACAGGCCCCTAACCAGAGAAGGGAAGTAATGGATCAACAA

AGTTAACTAGCAGGTCAGGATCACGCAATTCATTTCACTCTGACTGGTAACATGTGACAGAAACAGTGTA

GGCTTATTGTATTTTCATGTAGAGTAGGACCCAAAAATCCACCCAAAGTCCTTTATCTATGCCACATCCT

TCTTATCTATACTTCCAGGACACTTTTTCTTCCTTATGATAAGGCTCTCTCTCTCTCCACACACACACAC

ACACACACACACACACACACACACACACACAAACACACACCCCGCCAACCAAGGTGCATGTAAAAAGA

TGTAGATTCCTCTGCCTTTCTCATCTACACAGCCCAGGAGGGTAAGTTAATATAAGAGGGATTTATTGGT

-continued

AAGAGATGATGCTTAATCTGTTTAACACTGGGCCTCAAAGAGAGAATTTCTTTTCTTCTGTACTTATTAA

GCACCTATTATGTGTTGAGCTTATATATACAAAGGGTTATTATATGCTAATATAGTAATAGTAATGGTGG

TTGGTACTATGGTAATTACCATAAAAATTATTATCCTTTTAAAATAAAGCTAATTATTATTGGATCTTTT

TTAGTATTCATTTTATGTTTTTTATGTTTTTGATTTTTTAAAAGACAATCTCACCCTGTTACCCAGGCTG

GAGTGCAGTGGTGCAATCATAGCTTTCTGCAGTCTTGAACTCCTGGGCTCAAGCAATCCTCCTGCCTTGG

CCTCCCAAAGTGTTGGGATACAGTCATGAGCCACTGCATCTGGCCTAGGATCCATTTAGATTAAAATATG

CATTTTAAATTTTAAAATAATATGGCTAATTTTTACCTTATGTAATGTGTATACTGGCAATAAATCTAGT

TTGCTGCCTAAAGTTTAAAGTGCTTTCCAGTAAGCTTCATGTACGTGAGGGGAGACATTTAAAGTGAAAC

AGACAGCCAGGTGTGGTGGCTCACGCCTGTAATCCCAGCACTCTGGGAGGCTGAGGTGGGTGGATCGCTT

GAGCCCTGGAGTTCAAGACCAGCCTGAGCAACATGGCAAAACGCTGTTTCTATAACAAAAATTAGCCGGG

CATGGTGGCATGTGCCTGTGGTCCCAGCTACTAGGGGGCTGAGGCAGGAGAATCGTTGGAGCCCAGGAGG

TCAAGGCTGCACTGAGCAGTGCTTGCGCCACTGCACTCCAGCCTGGGTGACAGGACCAGACCTTGCCTCA

AAAAAATAAGAAGAAAAATTAAAAATAAATGGAAACAACTACAAAGAGCTGTTGTCCTAGATGAGCTACT

TAGTTAGGCTGATATTTTGGTATTTAACTTTTAAAGTCAGGGTCTGTCACCTGCACTACATTATTAAAAT

ATCAATTCTCAATGTATATCCACACAAAGACTGGTACGTGAATGTTCATAGTACCTTTATTCACAAAACC

CCAAAGTAGAGACTATCCAAATATCCATCAACAAGTGAACAAATAAACAAAATGTGCTATATCCATGCAA

TGGAATACCACCCTGCAGTACAAAGAAGCTACTTGGGGATGAATCCCAAAGTCATGACGCTAAATGAAAG

AGTCAGACATGAAGGAGGAGATAATGTATGCCATACGAAATTCTAGAAAATGAAAGTAACTTATAGTTAC

AGAAAGCAAATCAGGGCAGGCATAGAGGCTCACACCTGTAATCCCAGCACTTTGAGAGGCCACGTGGGAA

GATTGCTAGAACTCAGGAGTTCAAGACCAGCCTGGGCAACACAGTGAAACTCCATTCTCCACAAAAATGG

GAAAAAAAGAAAGCAAATCAGTGGTTGTCCTGTGGGGAGGGGAAGGACTGCAAAGAGGGAAGAAGCTCTG

GTGGGGTGAGGGTGGTGATTCAGGTTCTGTATCCTGACTGTGGTAGCAGTTTGGGGTGTTTACATCCAAA

AATATTCGTAGAATTATGCATCTTAAATGGGTGGAGTTTACTGTATGTAAATTATACCTCAATGTAAGAA

AAAATAATGTGTAAGAAAACTTTCAATTCTCTTGCCAGCAAACGTTATTCAAATTCCTGAGCCCTTTACT

TCGCAAATTCTCTGCACTTCTGCCCCGTACCATTAGGTGACAGCACTAGCTCCACAAATTGGATAAATGC

ATTTCTGGAAAAGACTAGGGACAAAATCCAGGCATCACTTGTGCTTTCATATCAACCATGCTGTACAGCT

TGTGTTGCTGTCTGCAGCTGCAATGGGGACTCTTGATTTCTTTAAGGAAACTTGGGTTACCAGAGTATTT

CCACAAATGCTATTCAAATTAGTGCTTATGATATGCAAGACACTGTGCTAGGAGCCAGAAAACAAAGAGG

AGGAGAAATCAGTCATTATGTGGGAACAACATAGCAAGATATTTAGATCATTTTGACTAGTTAAAAAAGC

AGCAGAGTACAAAATCACACATGCAATCAGTATAATCCAAATCATGTAAATATGTGCCTGTAGAAAGACT

AGAGGAATAAACACAAGAATCTTAACAGTCATTGTCATTAGACACTAAGTCTAATTATTATTATTAGACA

CTATGATATTTGAGATTTAAAAAATCTTTAATATTTTAAAATTTAGAGCTCTTCTATTTTTCCATAGTAT

TCAAGTTTGACAATGATCAAGTATTACTCTTTCTTTTTTTTTTTTTTTTTTTTTTTTTGAGATGGAGTTT

TGGTCTTGTTGCCCATGCTGGAGTGGAATGGCATGACCATAGCTCACTGCAACCTCCACCTCCTGGGTTC

AAGCAAAGCTGTCGCCTCAGCCTCCCGGGTAGATGGGATTACAGGCGCCCACCACCACACTCGGCTAATG

TTTGTATTTTTAGTAGAGATGGGGTTTCACCATGTTGGCCAGGCTGGTCTCAAACTCCTGACCTCAGAGG

ATCCACCTGCCTCAGCCTCCCAAAGTGCTGGGATTACAGATGTAGGCCACTGCGCCCGGCCAAGTATTGC

TCTTATACATTAAAAAACAGGTGTGAGCCACTGCGCCCAGCCAGGTATTGCTCTTATACATTAAAAAATA

GGCCGGTGCAGTGGCTCACGCCTGTAATCCCAGCACTTTGGGAAGCCAAGGCGGGCAGAACACCCGAGGT

CAGGAGTCCAAGGCCAGCCTGGCCAAGATGGTGAAACCCCGTCTCTATTAAAAATACAAACATTACCTGG

GCATGATGGTGGGCGCCTGTAATCCCAGCTACTCAGGAGGCTGAGGCAGGAGGATCCGCGGAGCCTGGCA

-continued

GATCTGCCTGAGCCTGGGAGGTTGAGGCTACAGTAAGCCAAGATCATGCCAGTATACTTCAGCCTGGGCG

ACAAAGTGAGACCGTAACAAAAAAAAAAAAATTTAAAAAAAGAAATTTAGATCAAGATCCAACTGTAAAA

AGTGGCCTAAACACCACATTAAAGAGTTTGGAGTTTATTCTGCAGGCAGAAGAGAACCATCAGGGGGTCT

TCAGCATGGGAATGGCATGGTGCACCTGGTTTTTGTGAGATCATGGTGGTGACAGTGTGGGGAATGTTAT

TTTGGAGGGACTGGAGGCAGACAGACCGGTTAAAAGGCCAGCACAACAGATAAGGAGGAAGAAGATGAGG

GCTTGGACCGAAGCAGAGAAGAGCAAACAGGGAAGGTACAAATTCAAGAAATATTGGGGGGTTTGAATCA

ACACATTTAGATGATTAATTAAATATGAGGACTGAGGAATAAGAAATGAGTCAAGGATGGTTCCAGGCTG

CTAGGCTGCTTACCTGAGGTGGCAAAGTCGGGAGGAGTGGCAGTTTAGGACAGGGGGCAGTTGAGGAATA

TTGTTTTGATCATTTTGAGTTTGAGGTACAAGTTGGACACTTAGGTAAAGACTGGAGGGGAAATCTGAAT

ATACAATTATGGGACTGAGGAACAAGTTTATTTTATTTTTTGTTTCGTTTTCTTGTTGAAGAACAAATTT

AATTGTAATCCCAAGTCATCAGCATCTAGAAGACAGTGGCAGGAGGTGACTGTCTTGTGGGTAAGGGTTT

GGGGTCCTTGATGAGTATCTCTCAATTGGCCTTAAATATAAGCAGGAAAAGGAGTTTATGATGGATTCCA

GGCTCAGCAGGGCTCAGGAGGGCTCAGGCAGCCAGCAGAGGAAGTCAGAGCATCTTCTTTGGTTTAGCCC

AAGTAATGACTTCCTTAAAAAGCTGAAGGAAAATCCAGAGTGACCAGATTATAAACTGTACTCTTGCATT

TTCTCTCCCTCCTCTCACCCACAGCCTCTTGATGAACCGGAGGAAGTTTCTTTACCAATTCAAAAATGTC

CGCTGGGCTAAGGGTCGGCGTGAGACCTACCTGTGCTACGTAGTGAAGAGGCGTGACAGTGCTACATCCT

TTTCACTGGACTTTGGTTATCTTCGCAATAAGGTATCAATTAAAGTCGGCTTTGCAAGCAGTTTAATGGT

CAACTGTGAGTGCTTTTAGAGCCACCTGCTGATGGTATTACTTCCATCCTTTTTTGGCATTTGTGTCTCT

ATCACATTCCTCAAATCCTTTTTTTTATTTCTTTTTCCATGTCCATGCACCCATATTAGACATGGCCCAA

AATATGTGATTTAATTCCTCCCCAGTAATGCTGGGCACCCTAATACCACTCCTTCCTTCAGTGCCAAGAA

CAACTGCTCCCAAACTGTTTACCAGCTTTCCTCAGCATCTGAATTGCCTTTGAGATTAATTAAGCTAAAA

GCATTTTTATATGGGAGAATATTATCAGCTTGTCCAAGCAAAAATTTTAAATGTGAAAAACAAATTGTGT

CTTAAGCATTTTTGAAAATTAAGGAAGAAGAATTTGGGAAAAAATTAACGGTGGCTCAATTCTGTCTTCC

AAATGATTTCTTTTCCCTCCTACTCACATGGGTCGTAGGCCAGTGAATACATTCAACATGGTGATCCCCA

GAAAACTCAGAGAAGCCTCGGCTGATGATTAATTAAATTGATCTTTCGGCTACCCGAGAGAATTACATTT

CCAAGAGACTTCTTCACCAAAATCCAGATGGGTTTACATAAACTTCTGCCCACGGGTATCTCCTCTCTCC

TAACACGCTGTGACGTCTGGGCTTGGTGGAATCTCAGGGAAGCATCCGTGGGGTGGAAGGTCATCGTCTG

GCTCGTTGTTTGATGGTTATATTACCATGCAATTTTCTTTGCCTACATTTGTATTGAATACATCCCAATC

TCCTTCCTATTCGGTGACATGACACATTCTATTTCAGAAGGCTTTGATTTTATCAAGCACTTTCATTTAC

TTCTCATGGCAGTGCCTATTACTTCTCTTACAATACCCATCTGTCTGCTTTACCAAAATCTATTTCCCCT

TTTCAGATCCTCCCAAATGGTCCTCATAAACTGTCCTGCCTCCACCTAGTGGTCCAGGTATATTTCCACA

ATGTTACATCAACAGGCACTTCTAGCCATTTTCCTTCTCAAAAGGTGCAAAAAGCAACTTCATAAACACA

AATTAAATCTTCGGTGAGGTAGTGTGATGCTGCTTCCTCCCAACTCAGCGCACTTCGTCTTCCTCATTCC

ACAAAAACCCATAGCCTTCCTTCACTCTGCAGGACTAGTGCTGCCAAGGGTTCAGCTCTACCTACTGGTG

TGCTCTTTTGAGCAAGTTGCTTAGCCTCTCTGTAACACAAGGACAATAGCTGCAAGCATCCCCAAAGATC

ATTGCAGGAGACAATGACTAAGGCTACCAGAGCCGCAATAAAAGTCAGTGAATTTTAGCGTGGTCCTCTC

TGTCTCTCCAGAACGGCTGCCACGTGGAATTGCTCTTCCTCCGCTACATCTCGGACTGGGACCTAGACCC

TGGCCGCTGCTACCGCGTCACCTGGTTCACCTCCTGGAGCCCCTGCTACGACTGTGCCCGACATGTGGCC

GACTTTCTGCGAGGGAACCCCAACCTCAGTCTGAGGATCTTCACCGCGCGCCTCTACTTCTGTGAGGACC

GCAAGGCTGAGCCCGAGGGGCTGCGGCGGCTGCACCGCGCCGGGGTGCAAATAGCCATCATGACCTTCAA

-continued

AGGTGCGAAAGGGCCTTCCGCGCAGGCGCAGTGCAGCAGCCCGCATTCGGGATTGCGATGCGGAATGAAT

GAGTTAGTGGGGAAGCTCGAGGGGAAGAAGTGGGCGGGGATTCTGGTTCACCTCTGGAGCCGAAATTAAA

GATTAGAAGCAGAGAAAAGAGTGAATGGCTCAGAGACAAGGCCCCGAGGAAATGAGAAAATGGGGCCAGG

GTTGCTTCTTTCCCCTCGATTTGGAACCTGAACTGTCTTCTACCCCCATATCCCCGCCTTTTTTTCCTTT

TTTTTTTTTTGAAGATTATTTTTACTGCTGGAATACTTTTGTAGAAAACCACGAAAGAACTTTCAAAGCC

TGGGAAGGGCTGCATGAAAATTCAGTTCGTCTCTCCAGACAGCTTCGGCGCATCCTTTTGGTAAGGGGCT

TCCTCGCTTTTTAAATTTTCTTTCTTTCTCTACAGTCTTTTTTGGAGTTTCGTATATTTCTTATATTTTC

TTATTGTTCAATCACTCTCAGTTTTCATCTGATGAAAACTTTATTTCTCCTCCACATCAGCTTTTTCTTC

TGCTGTTTCACCATTCAGAGCCCTCTGCTAAGGTTCCTTTTCCCTCCCTTTTCTTTCTTTTGTTGTTTCA

CATCTTTAAATTTCTGTCTCTCCCCAGGGTTGCGTTTCCTTCCTGGTCAGAATTCTTTTCTCCTTTTTTT

TTTTTTTTTTTTTTTTTTTAAACAAACAAACAAAAAACCCAAAAAAACTCTTTCCCAATTTACTTTCTT

CCAACATGTTACAAAGCCATCCACTCAGTTTAGAAGACTCTCCGGCCCCACCGACCCCCAACCTCGTTTT

GAAGCCATTCACTCAATTTGCTTCTCTCTTTCTCTACAGCCCCTGTATGAGGTTGATGACTTACGAGACG

CATTTCGTACTTTGGGACTTTGATAGCAACTTCCAGGAATGTCACACACGATGAAATATCTCTGCTGAAG

ACAGTGGATAAAAAACAGTCCTTCAAGTCTTCTCTGTTTTTATTCTTCAACTCTCACTTTCTTAGAGTTT

ACAGAAAAAAATATTTATATACGACTCTTTAAAAAGATCTATGTCTTGAAAATAGAGAAGGAACACAGGTC

TGGCCAGGGACGTGCTGCAATTGGTGCAGTTTTGAATGCAACATTGTCCCCTACTGGGAATAACAGAACT

GCAGGACCTGGGAGCATCCTAAAGTGTCAACGTTTTTCTATGACTTTTAGGTAGGATGAGAGCAGAAGGT

AGATCCTAAAAAGCATGGTGAGAGGATCAAATGTTTTTATATCAACATCCTTTATTATTTGATTCATTTG

AGTTAACAGTGGTGTTAGTGATAGATTTTTCTATTCTTTTCCCTTGACGTTTACTTTCAAGTAACACAAA

CTCTTCCATCAGGCCATGATCTATAGGACCTCCTAATGAGAGTATCTGGGTGATTGTGACCCCAAACCAT

CTCTCCAAAGCATTAATATCCAATCATGCGCTGTATGTTTTAATCAGCAGAAGCATGTTTTTATGTTTGT

ACAAAAGAAGATTGTTATGGGTGGGGATGGAGGTATAGACCATGCATGGTCACCTTCAAGCTACTTTAAT

AAAGGATCTTAAAATGGGCAGGAGGACTGTGAACAAGACACCCTAATAATGGGTTGATGTCTGAAGTAGC

AAATCTTCTGGAAACGCAAACTCTTTTAAGGAAGTCCCTAATTTAGAAACACCCACAAACTTCACATATC

ATAATTAGCAAACAATTGGAAGGAAGTTGCTTGAATGTTGGGGAGAGGAAAATCTATTGGCTCTCGTGGG

TCTCTTCATCTCAGAAATGCCAATCAGGTCAAGGTTTGCTACATTTTGTATGTGTGTGATGCTTCTCCCA

AAGGTATATTAACTATATAAGAGAGTTGTGACAAAACAGAATGATAAAGCTGCGAACCGTGGCACACGCT

CATAGTTCTAGCTGCTTGGGAGGTTGAGGAGGGAGGATGGCTTGAACACAGGTGTTCAAGGCCAGCCTGG

GCAACATAACAAGATCCTGTCTCTCAAAAAAAAAAAAAAAAAAAAAGAAAGAGAGAGGGCCGGGCGTGGTG

GCTCACGCCTGTAATCCCAGCACTTTGGGAGGCCGAGCCGGGCGGATCACCTGTGGTCAGGAGTTTGAGA

CCAGCCTGGCCAACATGGCAAAACCCCGTCTGTACTCAAAATGCAAAAATTAGCCAGGCGTGGTAGCAGG

CACCTGTAATCCCAGCTACTTGGGAGGCTGAGGCAGGAGAATCGCTTGAACCCAGGAGGTGGAGGTTGCA

GTAAGCTGAGATCGTGCCGTTGCACTCCAGCCTGGGCGACAAGAGCAAGACTCTGTCTCAGAAAAAAAAA

AAAAAAAGAGAGAGAGAGAGAAAGAGAACAATATTTGGGAGAGAAGGATGGGGAAGCATTGCAAGGAAAT

TGTGCTTTATCCAACAAAATGTAAGGAGCCAATAAGGGATCCCTATTTGTCTCTTTTGGTGTCTATTTGT

CCCTAACAACTGTCTTTGACAGTGAGAAAAATATTCAGAATAACCATATCCCTGTGCCGTTATTACCTAG

CAACCCTTGCAATGAAGATGAGCAGATCCACAGGAAAACTTGAATGCACAACTGTCTTATTTTAATCTTA

TTGTACATAAGTTTGTAAAAGAGTTAAAAATTGTTACTTCATGTATTCATTTATATTTTATATTATTTTG

CGTCTAATGATTTTTTATTAACATGATTTCCTTTTCTGATATATTGAAATGGAGTCTCAAAGCTTCATAA

ATTTATAACTTTAGAAATGATTCTAATAACAACGTATGTAATTGTAACATTGCAGTAATGGTGCTACGAA

-continued

```
GCCATTTCTCTTGATTTTTAGTAAACTTTTATGACAGCAAATTTGCTTCTGGCTCACTTTCAATCAGTTA

AATAAATGATAAATAATTTTGGAAGCTGTGAAGATAAAATACCAAATAAAATAATATAAAAGTGATTTAT

ATGAAGTTAAAATAAAAAATCAGTATGATGGAATAAACTTG
```

Other exemplary deaminases that can be fused to Cas9 according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal). Human AID:

```
Human AID:
                                                              (SEQ ID NO: 81)
MDSLLMNRRKFLYQFKNVRWAKGRRETYLCYVVKRRDSATSFSLDFGYLRNKNGCH

VELLFLRYISDWDLDPGRCYRVTWFTSWSPCYDCARHVADFLRGNPNLSLRIFTARLYF

CEDRKAEPEGLRRLHRAGVQIAIMTFKDYFYCWNTFVENHERTFKAWEGLHENSVRLS

RQLRRILLPLYEVDDLRDAFRTLGL

(underline: nuclear localization sequence; double underline: nuclear export signal)

Mouse AID:
                                                              (SEQ ID NO: 82)
MDSLLMKQKKFLYHFKNVRWAKGRHETYLCYVVKRRDSATSCSLDFGHLRNKSGCH

VELLFLRYISDWDLDPGRCYRVTWFTSWSPCYDCARHVAEFLRWNPNLSLRIFTARLYF

CEDRKAEPEGLRRLHRAGVQIGIMTFKDYFYCWNTFVENRERTFKAWEGLHENSVRLT

RQLRRILLPLYEVDDLRDAFRMLGF

(underline: nuclear localization sequence; double underline: nuclear export signal)

Canine AID:
                                                              (SEQ ID NO: 83)
MDSLLMKQRKFLYHFKNVRWAKGRHETYLCYVVKRRDSATSFSLDFGHLRNKSGCHV

ELLFLRYISDWDLDPGRCYRVTWFTSWSPCYDCARHVADFLRGYPNLSLRIFAARLYFC

EDRKAEPEGLRRLHRAGVQIAIMTFKDYFYCWNTFVENREKTFKAWEGLHENSVRLSR

QLRRILLPLYEVDDLRDAFRTLGL

(underline: nuclear localization sequence; double underline: nuclear export signal)

Bovine AID:
                                                              (SEQ ID NO: 84)
MDSLLKKQRQFLYQFKNVRWAKGRHETYLCYVVKRRDSPTSFSLDFGHLRNKAGCHV

ELLFLRYISDWDLDPGRCYRVTWFTSWSPCYDCARHVADFLRGYPNLSLRIFTARLYFC

DKERKAEPEGLRRLHRAGVQIAIMTFKDYFYCWNTFVENHERTFKAWEGLHENSVRLS

RQLRRILLPLYEVDDLRDAFRTLGL

(underline: nuclear localization sequence; double underline: nuclear export signal)

Rat AID
                                                              (SEQ ID NO: 85)
MAVGSKPKAALVGPHWERERIWCFLCSTGLGTQQTGQTSRWLRPAATQDPVSPPRSLL

MKQRKFLYHFKNVRWAKGRHETYLCYVVKRRDSATSFSLDFGYLRNKSGCHVELLFL

RYISDWDLDPGRCYRVTWFTSWSPCYDCARHVADFLRGNPNLSLRIFTARLTGWGALP

AGLMSPARPSDYFYCWNTFVENHERTFKAWEGLHENSVRLSRRLRRILLPLYEVDDLR

DAFRTLGL

(underline: nuclear localization sequence; double underline: nuclear export signal)
```

-continued

Mouse APOBEC-3

(SEQ ID NO: 86)

MGPFCLGCSHRKCYSPIRNLISQETFKFHFKNLGYAKGRKDTFLCYEVTRKDCDSPVSL

HHGVFKNKDNI*HAEICFLYWFHDKVLKVLSPREEFKITWYMSWSPCFEC*AEQIVRFLATHH

NLSLDIFSSRLYNVQDPETQQNLCRLVQEGAQVAAMDLYEFKKCWKKFVDNGGRRFR

PWKRLLTNFRYQDSKLQEILRPCYIPVPSSSSSTLSNICLTKGLPETRFCVEGRRMDPLSE

EEFYSQFYNQRVKHLCYYHRMKPYLCYQLEQFNGQAPLKGCLLSEKGKQ*HAEILFLDKI*

*RSMELSQVTITCYLTWSPCPNC*AWQLAAFKRDRPDLILHIYTSRLYFHWKRPFQKGLCSL

WQSGILVDVMDLPQFTDCWTNFVNPKRPFWPWKGLEIISRRTQRRLRRIKESWGLQDL

VNDFGNLQLGPPMS (italic: nucleic acid editing domain)

Rat APOBEC-3:

(SEQ ID NO: 87)

MGPFCLGCSHRKCYSPIRNLISQETFKFHFKNRLRYAIDRKDTFLCYEVTRKDCDSPVSL

HHGVFKNKDNI*HAEICFLYWFHDKVLKVLSPREEFKITWYMSWSPCFEC*AEQVLRFLATH

HNLSLDIFSSRLYNIRDPENQQNLCRLVQEGAQVAAMDLYEFKKCWKKFVDNGGRRFR

PWKKLLTNFRYQDSKLQEILRPCYIPVPSSSSSTLSNICLTKGLPETRFCVERRRVHLLSE

EEFYSQFYNQRVKHLCYYHGVKPYLCYQLEQFNGQAPLKGCLLSEKGKQ*HAEILFLDKI*

*RSMELSQVIITCYLTWSPCPNC*AWQLAAFKRDRPDLILHIYTSRLYFHWKRPFQKGLCSL

WQSGILVDVMDLPQFTDCWTNFVNPKRPFWPWKGLEIISRRTQRRLHRIKESWGLQDL

VNDFGNLQLGPPMS (italic: nucleic acid editing domain)

Rhesus macaque APOBEC-3G:

(SEQ ID NO: 88)

MVEPMDPRTFVSNFNNRPILSGLNTVWLCCEVKTKDPSGPPLDAKIFQGKVYSKAKY*H*

*PEMRFLRWFHKWRQLHHDQEYKVTWYVSWSPCTRC*ANSVATFLAKDPKVTLTIFVARLY

YFWKPDYQQALRILCQKRGGPHATMKIMNYNEFQDCWNKFVDGRGKPFKPRNNLPKH

YTLLQATLGELLRHLMDPGTFTSNFNNKPWVSGQHETYLCYKVERLHNDTWVPLNQH

RGFLRNQAPNIFIGFPKGR*HAELCFLDLIPFWKLDGQQYRVTCFTSWSPCFSC*AQEMAKFIS

NNEHVSLCIFAARIYDDQGRYQEGLRALHRDGAKIAMMNYSEFEYCWDTFVDRQGRPF

QPWDGLDEHSQALSGRLRAI (italic: nucleic acid editing domain; underline: cytoplasmic localization signal)

Chimpanzee APOBEC-3G:

(SEQ ID NO: 89)

MKPHFRNPVERMYQDTFSDNFYNRPILSHRNTVWLCYEVKTKGPSRPPLDAKIFRGQV

YSKLKY*HPEMRFFHWFSKWRKLHRDQEYEVTWYISWSPCTKC*TRDVATFLAEDPKVTLTI

FVARLYYFWDPDYQEALRSLCQKRDGPRATMKIMNYDEFQHCWSKFVYSQRELFEPW

NNLPKYYILLHIMLGEILRHSMDPPTFTSNFNNELWVRGRHETYLCYEVERLHNDTWVL

LNQRRGFLCNQAPHKHGFLEGR*HAELCFLDVIPFWKLDLHQDYRVTCFTSWSPCFSC*AQE

MAKFISNNKHVSLCIFAARIYDDQGRCQEGLRTLAKAGAKISIMTYSEFKHCWDTFVDH

QGCPFQPWDGLEEHSQALSGRLRAILQNQGN (italic: nucleic acid editing domain; underline: cytoplasmic localization signal)

Green monkey APOBEC-3G:

(SEQ ID NO: 90)

MNPQIRNMVEQMEPDIFVYYFNNRPILSGRNTVWLCYEVKTKDPSGPPLDANIFQGKLY

PEAKD*HPEMKFLHWFRKWRQLHRDQEYEVTWYVSWSPCTRC*ANSVATFLAEDPKVTLTIF

-continued

VARLYYFWKPDYQQALRILCQERGGPHATMKIMNYNEFQHCWNEFVDGQGKPFKPRK

NLPKHYTLLHATLGELLRHVMDPGTFTSNFNNKPWVSGQRETYLCYKVERSHNDTWV

LLNQHRGFLRNQAPDRHGFPKGR*HAELCFLDLIPFWKLDDQQYRVTCFTSWSPCFSC*AQK

MAKFISNNKHVSLCIFAARIYDDQGRCQEGLRTLHRDGAKIAVMNYSEFEYCWDTFVD

RQGRPFQPWDGLDEHSQALSGRLRAI (italic: nucleic acid editing domain; underline: cytoplasmic localization signal)

Human APOBEC-3G:

(SEQ ID NO: 91)

MKPHFRNTVERMYRDTFSYNFYNRPILSRRNTVWLCYEVKTKGPSRPPLDAKIFRGQV

YSELKY*HPEMRFFHWFSKWRKLHRDQEYEVTWYISWSPCTKC*TRDMATFLAEDPKVTLTI

FVARLYYFWDPDYQEALRSLCQKRDGPRATMKIMNYDEFQHCWSKFVYSQRELFEPW

NNLPKYYILLHIMLGEILRHSMDPPTFTFNFNNEPWVRGRHETYLCYEVERMHNDTWV

LLNQRRGFLCNQAPHKHGFLEGR*HAELCFLDVIPFWKLDLDQDYRVTCFTSWSPCFSC*AQ

EMAKFISKNKHVSLCIFTARIYDDQGRCQEGLRTLAEAGAKISIMTYSEFKHCWDTFVD

HQGCPFQPWDGLDEHSQDLSGRLRAILQNQEN (italic: nucleic acid editing domain; underline: cytoplasmic localization signal)

Human APOBEC-3F:

(SEQ ID NO: 92)

MKPHFRNTVERMYRDTFSYNFYNRPILSRRNTVWLCYEVKTKGPSRPRLDAKIFRGQV

YSQPEH*HAEMCFLSWFCGNQLPAYKCFQITWFVSWTPCPDC*VAKLAEFLAEHPNVTLTIS

AARLYYYWERDYRRALCRLSQAGARVKIMDDEEFAYCWENFVYSEGQPFMPWYKFD

DNYAFLHRTLKEILRNPMEAMYPHIFYFHFKNLRKAYGRNESWLCFTMEVVKHESPVS

WKRGVFRNQVDPETH*CHAERCFLSWFCDDILSPNTNYEVTWYTSWSPCPEC*AGEVAEF

LARHSNVNLTIFTARLYYFWDTDYQEGLRSLSQEGASVEIMGYKDFKYCWENFVYND

DEPFKPWKGLKYNFLFLDSKLQEILE (italic: nucleic acid editing domain)

Human APOBEC-3B:

(SEQ ID NO: 93)

MNPQIRNPMERMYRDTFYDNFENEPILYGRSYTWLCYEVKIKRGRSNLLWDTGVFRGQ

VYFKPQY*HAEMCFLSWFCGNQLPAYKCFQITWFVSWTPCPDC*VAKLAEFLSEHPNVTLTI

SAARLYYYWERDYRRALCRLSQAGARVTIMDYEEFAYCWENFVYNEGQQFMPWYKF

DENYAFLHRTLKEILRYLMDPDTFTFNFNNDPLVLRRRQTYLCYEVERLDNGTWVLMD

QHMGFLCNEAKNLLCGFY*GRHAELRFLDLVPSLQLDPAQIYRVTWFISWSPCFSWGC*AGE

VRAFLQENTHVRLRIFAARIYDYDPLYKEALQMLRDAGAQVSIMTYDEFEYCWDTFVY

RQGCPFQPWDGLEEHSQALSGRLRAILQNQGN (italic: nucleic acid editing domain)

Rat APOBEC-3B:

(SEQ ID NO: 94)

MQPQGLGPNAGMGPVCLGCSHRRPYSPIRNPLKKLYQQTFYFHFKNVRYAWGRKNNF

LCYEVNGMDCALPVPLRQGVFRKQGHIHAELCFIYWFHDKVLRVLSPMEEFKVTWYM

SWSPCSKCAEQVARFLAAHRNLSLAIFSSRLYYYLRNPNYQQKLCRLIQEGVHVAAMD

LPEFKKCWNKFVDNDGQPFRPWMRLRINFSFYDCKLQEIFSRMNLLREDVFYLQFNNS

HRVKPVQNRYYRRKSYLCYQLERANGQEPLKGYLLYKKGEQHVEILFLEKMRSMELS

-continued

QVRITCYLTWSPCPNCARQLAAFKKDHPDLILRIYTSRLYFWRKKFQKGLCTLWRSGIH

VDVMDLPQFADCWTNFVNPQRPFRPWNELEKNSWRIQRRLRRIKESWGL

Bovine APOBEC-3B:

(SEQ ID NO: 95)

DGWEVAFRSGTVLKAGVLGVSMTEGWAGSGHPGQGACVWTPGTRNTMNLLREVLFK

QQFGNQPRVPAPYYRRKTYLCYQLKQRNDLTLDRGCFRNKKQRHAERFIDKINSLDLN

PSQSYKIICYITWSPCPNCANELVNFITRNNHLKLEIFASRLYFHWIKSFKMGLQDLQNA

GISVAVMTHTEFEDCWEQFVDNQSRPFQPWDKLEQYSASIRRRLQRILTAPI

Chimpanzee APOBEC-3B:

(SEQ ID NO: 96)

MNPQIRNPMEWMYQRTFYYNFENEPILYGRSYTWLCYEVKIRRGHSNLLWDTGVFRG

QMYSQPEHHAEMCFLSWFCGNQLSAYKCFQITWFVSWTPCPDCVAKLAKFLAEHPNV

TLTISAARLYYYWERDYRRALCRLSQAGARVKIMDDEEFAYCWENFVYNEGQPFMPW

YKFDDNYAFLHRTLKEIIRHLMDPDTFTFNFNNDPLVLRRHQTYLCYEVERLDNGTWV

LMDQHMGFLCNEAKNLLCGFYGRHAELRFLDLVPSLQLDPAQIYRVTWFISWSPCFSW

GCAGQVRAFLQENTHVRLRIFAARIYDYDPLYKEALQMLRDAGAQVSIMTYDEFEYC

WDTFVYRQGCPFQPWDGLEEHSQALSGRLRAILQVRASSLCMVPHRPPPPPQSPGPCLP

LCSEPPLGSLLPTGRPAPSLPFLLTASFSFPPPASLPPLPSLSLSPGHLPVPSFHSLTSCSIQP

PCSSRIRETEGWASVSKEGRDLG

Human APOBEC-3C:

(SEQ ID NO: 97)

MNPQIRNPMKAMYPGTFYFQFKNLWEANDRNETWLCFTVEGIKRRSVVSWKTGVFRN

QVDSETH*CHAERCFLSWFCDDILSPNTKYQVTWYTSWSPCPDC*AGEVAEFLARHSNVNLT

IFTARLYYFQYPCYQEGLRSLSQEGVAVEIMDYEDFKYCWENFVYNDNEPFKPWKGLK

TNFRLLKRRLRESLQ (italic: nucleic acid editing domain)

Gorilla APOBEC-3C3C (SEQ ID NO: 98)

MNPQIRNPMKAMYPGTFYFQFKNLWEANDRNETWLCFTVEGIKRRSVVSWKTGVFRN

QVDSETH*CHAERCFLSWECDDILSPNTIVYQVTWYTSWSPCPEC*AGEVAEFLARHSNVNLTI

FTARLYYFQDTDYQEGLRSLSQEGVAVKIMDYKDFKYCWENFVYNDDEPFKPWKGLK

YNFRFLKRRLQEILE

Human APOBEC-3A:

(SEQ ID NO: 99)

MEASPASGPRHLMDPHIFTSNFNNGIGRHKTYLCYEVERLDNGTSVKMDQHRGFLHNQ

AKNLLCGFYGR*HAELRFLDLVPSLQLDPAQIYRVTWFISWSPCFSWGC*AGEVRAFLQENT

HVRLRIFAARIYDYDPLYKEALQMLRDAGAQVSIMTYDEFKHCWDTFVDHQGCPFQP

WDGLDEHSQALSGRLRAILQNQGN (italic: nucleic acid editing domain)

Rhesus macaque APOBEC-3A:

(SEQ ID NO: 100)

MDGSPASRPRHLMDPNTFTFNFNNDLSVRGRHQTYLCYEVERLDNGTWVPMDERRGF

LCNKAKNVPCGDYGC*HVELRFLCEVPSWQLDPAQTYRVTWFISWSPC*FRRGCAGQVRVF

-continued

LQENKHVRLRIFAARIYDYDPLYQEALRTLRDAGAQVSIMTYEEFKHCWDTFVDRQGR

PFQPWDGLDEHSQALSGRLRAILQNQGN (italic: nucleic acid editing domain)

Bovine APOBEC-3A3A:

(SEQ ID NO: 101)

MDEYTFTENFNNQGWPSKTYLCYEMERLDGDATIPLDEYKGFVRNKGLDQPEKPC*HAE*

*LYFLGKIHSWNLDRNQHYRLTCFISWSPC*YDCAQKLTTFLKENHHISLHILASRIYTHNRFG

CHQSGLCELQAAGARITIMTFEDFKHCWETFVDHKGKPFQPWEGLNVKSQALCTELQA

ILKTQQN (italic: nucleic acid editing domain)

Human APOBEC-3H:

(SEQ ID NO: 102)

MALLTAETFRLQFNNKRRLRRPYYPRKALLCYQLTPQNGSTPTRGYFENKKKC*HAEICF*

*INEIKSMGLDETQCYQVTCYLTWSPCSSC*AWELVDFIKAHDHLNLGIFASRLYYHWCKPQ

QKGLRLLCGSQVPVEVMGFPKFADCWENFVDHEKPLSFNPYKMLEELDKNSRAIKRRL

ERIKIPGVRAQGRYMDILCDAEV (italic: nucleic acid editing domain)

Rhesus macaque APOBEC-3H:

(SEQ ID NO: 103)

MALLTAKTFSLQFNNKRRVNKPYYPRKALLCYQLTPQNGSTPTRGHLKNKKKDHAEIR

FINKIKSMGLDETQCYQVTCYLTWSPCPSCAGELVDFIKAHRHLNLRIFASRLYYHWRP

NYQEGLLLLCGSQVPVEVMGLPEFTDCWENFVDHKEPPSFNPSEKLEELDKNSQAIKRR

LERIKSRSVDVLENGLRSLQLGPVTPSSSIRNSR

Human APOBEC-3D:

(SEQ ID NO: 104)

MNPQIRNPMERMYRDTFYDNFENEPILYGRSYTWLCYEVKIKRGRSNLLWDTGVFRGP

VLPKRQSNHRQEVYFRFEN*HAEMCFLSWFCGNRLPANRRFQITWFVSWNPC*LPCVVKVT

KFLAEHPNVTLTISAARLYYYRDRDWRWVLLRLHKAGARVKIMDYEDFAYCWENFVC

NEGQPFMPWYKFDDNYASLHRTLKEILRNPMEAMYPHIFYFHFKNLLKACGRNESWLC

FTMEVTKHHSAVFRKRGVFRNQVDPETHC*HAERCFLSWFCDDILSPNTNYEVTWYTSWSP*

*CPEC*AGEVAEFLARHSNVNLTIFTARLCYFWDTDYQEGLCSLSQEGASVKIMGYKDFV

SCWKNFVYSDDEPFKPWKGLQTNFRLLKRRLREILQ (italic: nucleic acid editing domain)

Human APOBEC-1:

(SEQ ID NO: 105)

MTSEKGPSTGDPTLRRRIEPWEFDVFYDPRELRKEACLLYEIKWGMSRKIWRSSGKNTT

NHVEVNFIKKFTSERDFHPSMSCSITWFLSWSPCWECSQAIREFLSRHPGVTLVIYVARL

FWHMDQQNRQGLRDLVNSGVTIQIMRASEYYHCWRNFVNYPPGDEAHWPQYPPLWM

MLYALELHCIILSLPPCLKISRRWQNHLTFFRLHLQNCHYQTIPPHILLATGLIHPSVAWR

Mouse APOBEC-1:

(SEQ ID NO: 106)

MSSETGPVAVDPTLRRRIEPHEFEVFFDPRELRKETCLLYEINWGGRHSVWRHTSQNTS

NHVEVNFLEKFTTERYFRPNTRCSITWFLSWSPCGECSRAITEFLSRHPYVTLFIYIARLY

-continued

HHTDQRNRQGLRDLISSGVTIQIMTEQEYCYCWRNFVNYPPSNEAYWPRYPHLWVKLY

VLELYCIILGLPPCLKILRRKQPQLTFFTITLQTCHYQRIPPHLLWATGLK

Rat APOBEC-1:

(SEQ ID NO: 107)

MSSETGPVAVDPTLRRRIEPHEFEVFFDPRELRKETCLLYEINWGGRHSIWRHTSQNTNK

HVEVNFIEKFTTERYFCPNTRCSITWFLSWSPCGECSRAITEFLSRYPHVTLFIYIARLYHH

ADPRNRQGLRDLISSGVTIQIMTEQESGYCWRNFVNYSPSNEAHWPRYPHLWVRLYVL

ELYCIILGLPPCLNILRRKQPQLTFFTIALQSCHYQRLPPHILWATGLK

Human APOBEC-2:

(SEQ ID NO: 108)

MAQKEEAAVATEAASQNGEDLENLDDPEKLKELIELPPFEIVTGERLPANFFKFQFRNV

EYSSGRNKTFLCYVVEAQGKGGQVQASRGYLEDEHAAAHAEEAFFNTILPAFDPALRY

NVTWYVSSSPCAACADRIIKTLSKTKNLRLLILVGRLFMWEEPEIQAALKKLKEAGCKL

RIMKPQDFEYVWQNFVEQEEGESKAFQPWEDIQENFLYYEEKLADILK

Mouse APOBEC-2:

(SEQ ID NO: 109)

MAQKEEAAEAAAPASQNGDDLENLEDPEKLKELIDLPPFEIVTGVRLPVNFFKFQFRNV

EYSSGRNKTFLCYVVEVQSKGGQAQATQGYLEDEHAGAHAEEAFFNTILPAFDPALKY

NVTWYVSSSPCAACADRILKTLSKTKNLRLLILVSRLFMWEEPEVQAALKKLKEAGCK

LRIMKPQDFEYIWQNFVEQEEGESKAFEPWEDIQENFLYYEEKLADILK

Rat APOBEC-2:

(SEQ ID NO: 110)

MAQKEEAAEAAAPASQNGDDLENLEDPEKLKELIDLPPFEIVTGVRLPVNFFKFQFRNV

EYSSGRNKTFLCYVVEAQSKGGQVQATQGYLEDEHAGAHAEEAFFNTILPAFDPALKY

NVTWYVSSSPCAACADRILKTLSKTKNLRLLILVSRLFMWEEPEVQAALKKLKEAGCK

LRIMKPQDFEYLWQNFVEQEEGESKAFEPWEDIQENFLYYEEKLADILK

Bovine APOBEC-2:

(SEQ ID NO: 111)

MAQKEEAAAAAEPASQNGEEVENLEDPEKLKELIELPPFEIVTGERLPAHYFKFQFRNV

EYSSGRNKTFLCYVVEAQSKGGQVQASRGYLEDEHATNHAEEAFFNSIMPTFDPALRY

MVTWYVSSSPCAACADRIVKTLNKTKNLRLLILVGRLFMWEEPEIQAALRKLKEAGCR

LRIMKPQDFEYIWQNFVEQEEGESKAFEPWEDIQENFLYYEEKLADILK

Petromyzon marinus CDA1 (pmCDA1)

(SEQ ID NO: 112)

MTDAEYVRIHEKLDIYTFKKQFFNNKKSVSHRCYVLFELKRRGERRACFWGYAVNK

PQSGTERGIHAEIFSIRKVEEYLRDNPGQFTINWYSSWSPCADCAEKILEWYNQELRG

NGHTLKIWACKLYYEKNARNQIGLWNLRDNGVGLNVMVSEHYQCCRKIFIQSSHNQ

LNENRWLEKTLKRAEKRRSELSFMIQVKILHTTKSPAV

Human APOBEC3G D316R D317R (SEQ ID NO: 113)

MKPHFRNTVERMYRDTFSYNFYNRPILSRRNTVWLCYEVKTKGPSRPPLDAKIFRGQ

VYSELKYHPEMRFFHWFSKWRKLHRDQEYEVTWYISWSPCTKCTRDMATFLAEDP

KVTLTIFVARLYYFWDPDYQEALRSLCQKRDGPRATMKFNYDEFQHCWSKFVYSQ

RELFEPWNNLPKYYILLHFMLGEILRHSMDPPTFTFNFNNEPWVRGRHETYLCYEVER

MEINDTWVLLNQRRGFLCNQAPHKHGFLEGRHAELCFLDVIPFWKLDLDQDYRVTC

-continued

```
FTSWSPCFSCAQEMAKFISKKHVSLCIFTARIYRRQGRCQEGLRTLAEAGAKISFT

YSEFKHCWDTFVDHQGCPFQPWDGLDEHSQDLSGRLRAILQNQEN

Human APOBEC3G chain A
                                                  (SEQ ID NO: 114)
MDPPTFTFNFNNEPWWGRHETYLCYEVERMEINDTWVLLNQRRGFLCNQAPHKHG

FLEGRHAELCFLDVIPFWKLDLDQDYRVTCFTSWSPCFSCAQEMAKFISKNKHVSLCI

FTARIYDDQGRCQEGLRTLAEAGAKISFTYSEFKHCWDTFVDHQGCPFQPWDGLD

EHSQDLSGRLRAILQ

Human APOBEC3G chain A D12 R D121R
                                                  (SEQ ID NO: 115)
MDPPTFTFNFNNEPWVRGRHETYLCYEVERMHNDTWVLLNQRRGFLCNQAPHKHG

FLEGRHAELCFLDVIPFWKLDLDQDYRVTCFTSWSPCFSCAQEMAKFISKNKHVSLCI

FTARIYRRQGRCQEGLRTLAEAGAKISFMTYSEFKHCWDTFVDHQGCPFQPWDGLDE

HSQDLSGRLRAILQ
```

Some aspects of the present disclosure are based on the recognition that modulating the deaminase domain catalytic activity of any of the fusion proteins described herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deamination window can prevent unwanted deamination of residues adjacent to specific target residues, which can decrease or prevent off-target effects.

For example, in some embodiments, an APOBEC deaminase incorporated into a base editor can comprise one or more mutations selected from the group consisting of H121X, H122X, R126X, R126X, R118X, W90X, W90X, and R132X of rAPOBEC1, or one or more corresponding mutations in another APOBEC deaminase, wherein X is any amino acid. In some embodiments, an APOBEC deaminase incorporated into a base editor can comprise one or more mutations selected from the group consisting of H121R, H122R, R126A, R126E, R118A, W90A, W90Y, and R132E of rAPOBEC1, or one or more corresponding mutations in another APOBEC deaminase.

In some embodiments, an APOBEC deaminase incorporated into a base editor can comprise one or more mutations selected from the group consisting of D316X, D317X, R320X, R320X, R313X, W285X, W285X, R326X of hAPOBEC3G, or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G, or one or more corresponding mutations in another APOBEC deaminase.

In some embodiments, an APOBEC deaminase incorporated into a base editor can comprise a H121R and a H122R mutation of rAPOBEC1, or one or more corresponding mutations in another APOBEC deaminase. In some embodiments an APOBEC deaminase incorporated into a base editor can comprise an APOBEC deaminase comprising a R126A mutation of rAPOBEC1, or one or more corresponding mutations in another APOBEC deaminase. In some embodiments, an APOBEC deaminase incorporated into a base editor can comprise an APOBEC deaminase comprising a R126E mutation of rAPOBEC1, or one or more corresponding mutations in another APOBEC deaminase. In some embodiments, an APOBEC deaminase incorporated into a base editor can comprise an APOBEC deaminase comprising a R118A mutation of rAPOBEC1, or one or more corresponding mutations in another APOBEC deaminase. In some embodiments, an APOBEC deaminase incorporated into a base editor can comprise an APOBEC deaminase comprising a W90A mutation of rAPOBEC1, or one or more corresponding mutations in another APOBEC deaminase. In some embodiments, an APOBEC deaminase incorporated into a base editor can comprise an APOBEC deaminase comprising a W90Y mutation of rAPOBEC1, or one or more corresponding mutations in another APOBEC deaminase. In some embodiments, an APOBEC deaminase incorporated into a base editor can comprise an APOBEC deaminase comprising a R132E mutation of rAPOBEC1, or one or more corresponding mutations in another APOBEC deaminase. In some embodiments an APOBEC deaminase incorporated into a base editor can comprise an APOBEC deaminase comprising a W90Y and a R126E mutation of rAPOBEC1, or one or more corresponding mutations in another APOBEC deaminase. In some embodiments, an APOBEC deaminase incorporated into a base editor can comprise an APOBEC deaminase comprising a R126E and a R132E mutation of rAPOBEC1, or one or more corresponding mutations in another APOBEC deaminase. In some embodiments, an APOBEC deaminase incorporated into a base editor can comprise an APOBEC deaminase comprising a W90Y and a R132E mutation of rAPOBEC1, or one or more corresponding mutations in another APOBEC deaminase. In some embodiments, an APOBEC deaminase incorporated into a base editor can comprise an APOBEC deaminase comprising a W90Y, R126E, and R132E mutation of rAPOBEC1, or one or more corresponding mutations in another APOBEC deaminase.

In some embodiments, an APOBEC deaminase incorporated into a base editor can comprise an APOBEC deaminase comprising a D316R and a D317R mutation of hAPOBEC3G, or one or more corresponding mutations in another APOBEC deaminase. In some embodiments, any of the fusion proteins provided herein comprise an APOBEC deaminase comprising a R320A mutation of hAPOBEC3G, or one or more corresponding mutations in another APOBEC deaminase. In some embodiments, an APOBEC deaminase incorporated into a base editor can comprise an APOBEC deaminase comprising a R320E mutation of hAPOBEC3G, or one or more corresponding mutations in another APOBEC deaminase. In some embodiments, an APOBEC deaminase incorporated into a base editor can comprise an APOBEC deaminase comprising a R313A mutation of hAPOBEC3G, or one or more corresponding mutations in another APOBEC deaminase. In some embodiments, an APOBEC deaminase incorporated into a base editor can comprise an APOBEC deaminase comprising a W285A mutation of hAPOBEC3G, or one or more corresponding mutations in another APOBEC deaminase. In some embodiments, an APOBEC deaminase incorporated into a base editor can comprise an APOBEC deaminase comprising a W285Y mutation of hAPOBEC3G, or one or more corresponding mutations in another APOBEC deaminase. In some embodiments, an APOBEC deaminase incorporated into a base editor can comprise an APOBEC deaminase comprising a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R320E mutation of hAPOBEC3G, or one or more corresponding mutations in another APOBEC deaminase. In some embodiments, an APOBEC deaminase incorporated into a base editor can comprise an APOBEC deaminase comprising a R320E and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y, R320E, and R326E mutation of hAPOBEC3G, or one or more corresponding mutations in another APOBEC deaminase.

A number of modified cytidine deaminases are commercially available, including but not limited to SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177).

Other exemplary deaminases that can be fused to Cas9 according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

Details of C to T nucleobase editing proteins are described in International PCT Application No. PCT/US2016/058344 (WO 2017/070632) and Komor, A. C., et al., "Programmable editing of a target base in genomic DNA without double-stranded DNA cleavage" Nature 533, 420-424 (2016), the entire contents of which are hereby incorporated by reference.

A to G Editing

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein can comprise a Cas9 domain that has reduced nuclease activity. In some embodiments, the fusion proteins provided herein can have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, an A-to-G base editor further comprises an inhibitor of inosine base excision repair, for example, a uracil glycosylase inhibitor (UGI) domain or a catalytically inactive inosine specific nuclease. Without wishing to be bound by any particular theory, the UGI domain or catalytically inactive inosine specific nuclease can inhibit or prevent base excision repair of a deaminated adenosine residue (e.g., inosine), which can improve the activity or efficiency of the base editor.

A base editor comprising an adenosine deaminase can act on any polynucleotide, including DNA, RNA and DNA-RNA hybrids. In certain embodiments, a base editor comprising an adenosine deaminase can deaminate a target A of a polynucleotide comprising RNA. For example, the base editor can comprise an adenosine deaminase domain capable of deaminating a target A of an RNA polynucleotide and/or a DNA-RNA hybrid polynucleotide. In an embodiment, an adenosine deaminase incorporated into a base editor comprises all or a portion of adenosine deaminase acting on RNA (ADAR, e.g., ADAR1 or ADAR2). In another embodiment, an adenosine deaminase incorporated into a base editor comprises all or a portion of adenosine deaminase acting on tRNA (ADAT). A base editor comprising an adenosine deaminase domain can also be capable of deaminating an A nucleobase of a DNA polynucleotide. In an embodiment an adenosine deaminase domain of a base editor comprises all or a portion of an ADAT comprising one or more mutations which permit the ADAT to deaminate a target A in DNA. For example, the base editor can comprise all or a portion of an ADAT from *Escherichia coli* (EcTadA) comprising one or more of the following mutations: D108N, A106V, D147Y, E155V, L84F, H123Y, I157F, or a corresponding mutation in another adenosine deaminase.

The adenosine deaminase can be derived from any suitable organism. In some embodiments, the adenosine deaminase is from a prokaryote. In some embodiments, the adenosine deaminase is from a bacterium. In some embodiments, the adenosine deaminase is from *Escherichia* co/i, *Staphylococcus aureus, Salmonella typhi, Shewanella putre-*

*faciens, Haemophilus influenzae, Caulobacter crescentus*, or *Bacillus subtilis*. In some embodiments, the adenosine deaminase is from *E. coli*. In some embodiments, the adenine deaminase is a naturally-occurring adenosine deaminase that includes one or more mutations corresponding to any of the mutations provided herein (e.g., mutations in ecTadA). The corresponding residue in any homologous protein can be identified by e.g., sequence alignment and determination of homologous residues. The mutations in any naturally-occurring adenosine deaminase (e.g., having homology to ecTadA) that corresponds to any of the mutations described herein (e.g., any of the mutations identified in ecTadA) can be generated accordingly.

TadA

In particular embodiments, the TadA is any one of the TadA described in PCT/US2017/045381 (WO 2018/027078), which is incorporated herein by reference in its entirety.

In one embodiment, a fusion protein of the invention comprises a wild-type TadA linked to TadA7.10, which is linked to Cas9 nickase. In particular embodiments, the fusion proteins comprise a single TadA7.10 domain (e.g., provided as a monomer). In other embodiments, the ABE7.10 editor comprises TadA7.10 and TadA(wt), which are capable of forming heterodimers. The relevant sequences follow:

```
                                   (SEQ ID NO: 116)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD,
which is termed "the TadA reference sequence"
or wild type TadA (TadA(wt)).

TadA7.10:
                                   (SEQ ID NO: 117)
SEVEFSHEYW MRHALTLAKR ARDEREVPVG AVLVLNNRVI

GEGWNRAIGL HDPTAHAEIM ALRQGGLVMQ NYRLIDATLY

VTFEPCVMCA GAMIHSRIGR VVFGVRNAKT GAAGSLMDVL

HYPGMNHRVE ITEGILADEC AALLCYFFRM PRQVFNAQKK

AQSSTD
```

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments the TadA deaminase is a full-length *E. coli* TadA deaminase. For example, in certain embodiments, the adenosine deaminase comprises the amino acid sequence:

```
                                   (SEQ ID NO: 118)
MRRAFITGVFFLSEVEFSHEYWMRHALTLAKRAWDEREVPVGAVLVHNNR

VIGEGWNRPIGRHDPTAHAEIMALRQGGLVMQNYRLIDATLYVTLEPCVM

CAGAMIHSRIGRVVFGARDAKTGAAGSLMDVLHHPGMNHRVEITEGILAD

ECAALLSDFFRMRRQEIKAQKKAQSSTD
```

It will be appreciated, however, that additional adenosine deaminases useful in the present application would be apparent to the skilled artisan and are within the scope of this disclosure. For example, the adenosine deaminase may be a homolog of adenosine deaminase acting on tRNA (AD AT). Exemplary AD AT homologs include, without limitation:

```
Staphylococcus aureus TadA:
                                   (SEQ ID NO: 119)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

RVVYGADDPKGGCS GS LMNLLQQS NFNHRAIVDKG VLKE AC S T

LLTTFFKNLRANKKS TN

Bacillus subtilis TadA:
                                   (SEQ ID NO: 120)
MTQDELYMKEAIKEAKKAEEKGEVPIGAVLVINGEIIARAHNLRETEQRS

IAHAEMLVIDEACKALGTWRLEGATLYVTLEPCPMCAGAVVLSRVEKVVF

GAFDPKGGC S GTLMN LLQEERFNHQAEVVSGVLEEECGGMLSAFFRE

LRKKKKAARKNLSE

Salmonella typhimurium (S. typhimurium) TadA:
                                   (SEQ ID NO: 121)
MPPAFITGVTSLSDVELDHEYWMRHALTLAKRAWDEREVPVGAVLVHNHR

VIGEGWNRPIGRHDPTAHAEIMALRQGGLVLQNYRLLDTTLYVTLEPCVM

CAGAMVHSRIGRVVFGARDAKTGAAGSLIDVLHHPGMNHRVEIIEGVLRD

ECATLLSDFFRMRRQEIKALKKADRAEGAGPAV

Shewanella putrefaciens (S. putrefaciens) TadA:
                                   (SEQ ID NO: 122)
MDE YWMQV AMQM AEKAEAAGE VPVGA VLVKDGQQIATGYNLS IS

QHDPT AHAEILCLRSAGKKLENYRLLDATLYITLEPCAMCAGAMVHSRI

ARVVYGARDEKTGAAGTVVNLLQHPAFNHQVEVTSGVLAEACSAQLSRFF

KRRRDEKKALKLAQRAQQGIE
```

-continued

*Haemophilus influenzae* F3031 (*H. influenzae*) TadA:

(SEQ ID NO: 123)

```
MDAAKVRSEFDEKMMRYALELADKAEALGEIPVGAVLVDDARNIIGEGWN
LSIVQSDPTAHAEIIALRNGAKNIQNYRLLNSTLYVTLEPCTMCAGAILH
S RIKRLVFG ASDYKTGAIGSRFHFFDDYKMNHTLEITSGVLAEECSQK
LSTFFQKRREEKKIEKALLKSLSDK
```

*Caulobacter crescentus* (*C. crescentus*) TadA:

(SEQ ID NO: 124)

```
MRTDESEDQDHRMMRLALDAARAAAEAGETPVGAVILDPSTGEVIATAGN
GPIAAHDPTAHAEIAAMRAAAAKLGNYRLTDLTLVVTLEPCAMCAGAISH
ARIGRVVFGADDPKGGAVVHGPKFFAQPTCHWRPEVTGGVLADESADLLR
GFFRARRKAKI
```

*Geobacter sulfurreducens* (*G. sulfurreducens*) TadA:

(SEQ ID NO: 125)

```
MSSLKKTPIRDDAYWMGKAIREAAKAAARDEVPIGAVIVRDGAVIGRGHN
LREGSNDPSAHAEMIAIRQAARRSANWRLTGATLYVTLEPCLMCMGAIIL
ARLERVVFGCYDPKGGAAGSLYDLSADPRLNHQVRLSPGVCQEECGTMLS
DFFRDLRRRKKAKATPALFIDERKVPPEP.
```

In some embodiments, the adenosine deaminase comprises a D108X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation relative to the TadA reference sequence, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an A106V mutation relative to the TadA reference sequence, or a corresponding mutation in another adenosine deaminase.

In some embodiments, the adenosine deaminase comprises a E155X mutation relative to the TadA reference sequence, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation relative to the TadA reference sequence, or a corresponding mutation in another adenosine deaminase.

In some embodiments, the adenosine deaminase comprises a D147X mutation, or a corresponding mutation in another adenosine deaminase, where the presence of X indicates any amino acid other than the corresponding amino acid in the wild-type adenosine deaminase. In some embodiments, the adenosine deaminase comprises a D147Y, mutation relative to the TadA reference sequence, or a corresponding mutation in another adenosine deaminase.

It should be appreciated that any of the mutations provided herein (e.g., TadA reference sequence) may be introduced into other adenosine deaminases, such as *E. coli* TadA (ecTadA), *S. aureus* TadA (saTadA), or other adenosine deaminases (e.g., bacterial adenosine deaminases). It would be apparent to the skilled artisan how to identify sequences that are homologous to the mutated residues relative to the TadA reference sequence. Thus, any of the mutations identified relative to the TadA reference sequence may be made in other adenosine deaminases that have homologous amino acid residues. It should also be appreciated that any of the mutations provided herein may be made individually or in any combination relative to the TadA reference sequence or another adenosine deaminase. For example, an adenosine deaminase may contain a D108N, a A106V, a E155V, and/or a D147Y mutation relative to the TadA reference sequence, or a corresponding mutation in another adenosine deaminase. In some embodiments, an adenosine deaminase comprises the following group of mutations (groups of mutations are separated by a ";") in TadA reference sequence, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D147Y; and D108N, A106V, E55V, and D147Y. It should be appreciated, however, that any combination of corresponding mutations provided herein may be made in an adenosine deaminase (e.g., wild type TadA or ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, 1156X, and/or K1157X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, 1951, V102A, F104L, AT06V, RT07C, or RT07H, or RT07P, D108G, or D108N, or D108V, or D108A, or D108Y, K1 101, M118K, N127S, A138V, F149Y, M151V, R153C, Q154L, 1156D, and/or K157R mutation relative to the TadA reference sequence, or one or more corresponding mutations in another adenosine deaminase.

In some embodiments, the adenosine deaminase comprises one or more of H8X, D108X, and/or N127X mutation relative to the TadA reference sequence, or one or more corresponding mutations in another adenosine deaminase, where X indicates the presence of any amino acid. In some embodiments, the adenosine deaminase comprises one or more of a H8Y, D108N, and/or N127S mutation relative to the TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X relative to the TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H relative to the TadA reference sequence, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H relative to the TadA reference sequence, or a corresponding mutation or mutations in another adenosine deaminase. In some embodiments, the adenosine deaminase comprises one, two, three, four, or five, mutations selected from the group consisting of H8Y, D108N, N127S, E155V, and T166P relative to the TadA reference sequence, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q relative to the TadA reference sequence, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V relative to the TadA reference sequence, or a corresponding mutation or mutations in another adenosine deaminase. In some embodiments, the adenosine deaminase comprises one, two, three, four, or five, mutations selected from the group consisting of H8Y, D108N, A109T, N127S, and E155G relative to the TadA reference sequence, or a corresponding mutation or mutations in another adenosine deaminase.

In some embodiments, the adenosine deaminase comprises one or more of the or one or more corresponding mutations in another adenosine deaminase. In some embodiments, the adenosine deaminase comprises a D108N, D108G, or D108V mutation relative to the TadA reference sequence, or corresponding mutations in another adenosine deaminase. In some embodiments, the adenosine deaminase comprises a A106V and D108N mutation relative to the TadA reference sequence, or corresponding mutations in another adenosine deaminase. In some embodiments, the adenosine deaminase comprises R107C and D108N mutations in TadA reference sequence, or corresponding mutations in another adenosine deaminase. In some embodiments, the adenosine deaminase comprises a H8Y, D108N, N127S, D147Y, and Q154H mutation relative to the TadA reference sequence, or corresponding mutations in another adenosine deaminase. In some embodiments, the adenosine deaminase comprises a H8Y, R24W, D108N, N127S, D147Y, and E155V mutation relative to the TadA reference sequence, or corresponding mutations in another adenosine deaminase. In some embodiments, the adenosine deaminase comprises a D108N, D147Y, and E155V mutation relative to the TadA reference sequence, or corresponding mutations in another adenosine deaminase. In some embodiments, the adenosine deaminase comprises a H8Y, D108N, and S127S mutation relative to the TadA reference sequence, or corresponding mutations in another adenosine deaminase. In some embodiments, the adenosine deaminase comprises a A106V, D108N, D147Y and E155V mutation relative to the TadA reference sequence, or corresponding mutations in another adenosine deaminase.

In some embodiments, the adenosine deaminase comprises one or more of a, S2X, H8X, I49X, L84X, H123X, N127X, 1156X and/or K160X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation relative to the TadA reference sequence, or one or more corresponding mutations in another adenosine deaminase.

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation relative to the TadA reference sequence, or a corresponding mutation in another adenosine deaminase.

In some embodiments, the adenosine deaminase comprises an H123X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an H123Y mutation relative to the TadA reference sequence, or a corresponding mutation in another adenosine deaminase.

In some embodiments, the adenosine deaminase comprises an I157X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an I157F mutation relative to the TadA reference sequence, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X relative to the TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F relative to the TadA reference sequence, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V relative to the TadA reference sequence.

In some embodiments, the adenosine deaminase comprises one, two, three, four, or five, mutations selected from the group consisting of H8Y, A106T, D108N, N127S, and K160S relative to the TadA reference sequence, or a corresponding mutation or mutations in another adenosine deaminase.

In some embodiments, the adenosine deaminase comprises one or more of a E25X, R26X, R107X, A142X, and/or A143X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation relative to the TadA reference sequence, or one or more corresponding mutations in another adenosine deaminase. In some embodiments, the adenosine deaminase comprises one or more of the mutations described herein corresponding to TadA reference sequence, or one or more corresponding mutations in another adenosine deaminase.

In some embodiments, the adenosine deaminase comprises an E25X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation relative to the TadA reference sequence, or a corresponding mutation in another adenosine deaminase.

In some embodiments, the adenosine deaminase comprises an R26X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises R26G, R26N, R26Q, R26C, R26L, or R26K mutation relative to the TadA reference sequence, or a corresponding mutation in another adenosine deaminase.

In some embodiments, the adenosine deaminase comprises an R107X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation relative to the TadA reference sequence, or a corresponding mutation in another adenosine deaminase.

In some embodiments, the adenosine deaminase comprises an A142X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation relative to the TadA reference sequence, or a corresponding mutation in another adenosine deaminase.

In some embodiments, the adenosine deaminase comprises an A143X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation relative to the TadA reference sequence, or a corresponding mutation in another adenosine deaminase.

In some embodiments, the adenosine deaminase comprises one or more of a H36X, N37X, P48X, I49X, R51X, M70X, N72X, D77X, E134X, S146X, Q154X, K157X, and/or K161X mutation relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation relative to the TadA reference sequence, or one or more corresponding mutations in another adenosine deaminase.

In some embodiments, the adenosine deaminase comprises an H36X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an H36L mutation relative to the TadA reference sequence, or a corresponding mutation in another adenosine deaminase.

In some embodiments, the adenosine deaminase comprises an N37X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an N37T, or N37S mutation relative to the TadA reference sequence, or a corresponding mutation in another adenosine deaminase.

In some embodiments, the adenosine deaminase comprises an P48X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an P48T, or P48L mutation relative to the TadA reference sequence, or a corresponding mutation in another adenosine deaminase.

In some embodiments, the adenosine deaminase comprises an R51X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation relative to the TadA reference sequence, or a corresponding mutation in another adenosine deaminase.

In some embodiments, the adenosine deaminase comprises an S146X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises an S146R, or S146C mutation relative to the TadA reference sequence, or a corresponding mutation in another adenosine deaminase.

In some embodiments, the adenosine deaminase comprises an K157X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a K157N mutation relative to the TadA reference sequence, or a corresponding mutation in another adenosine deaminase.

In some embodiments, the adenosine deaminase comprises an P48X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation relative to the TadA reference sequence, or a corresponding mutation in another adenosine deaminase.

In some embodiments, the adenosine deaminase comprises an A142X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a A142N mutation relative to the TadA reference sequence, or a corresponding mutation in another adenosine deaminase.

In some embodiments, the adenosine deaminase comprises an W23X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a W23R, or W23L mutation relative to the TadA reference sequence, or a corresponding mutation in another adenosine deaminase.

In some embodiments, the adenosine deaminase comprises an R152X mutation relative to the TadA reference sequence, or a corresponding mutation in another adenosine deaminase, where X indicates any amino acid other than the corresponding amino acid in the wild-type adenosine deaminase. In some embodiments, the adenosine deaminase comprises a R152P, or R152H mutation relative to the TadA reference sequence, or a corresponding mutation in another adenosine deaminase.

In one embodiment, the adenosine deaminase may comprise the mutations H36L, R51L, L84F, A106V, D108N, H123Y, S146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses:

(A106V_D108N), (R107C_D108N), (H8Y_D108N_S127S_D147Y_Q154H), (H8Y_R24W_D108N_N127S_D147Y_E155V), (D108N_D147Y_E155V), (H8Y_D108N_S127S), (H8Y_D108N_N127S_D147Y_Q154H), (A106V_D108N_D147Y_E155V), (D108Q_D147Y_E155V) (D108M_D147Y_E155V), (D108L_D147Y_E155V), (D108K_D147Y_E155V), (D108I_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_I156Y), (L84F_A106V_D108N_H123Y_D147Y_E155V_I156F), (D103A_D104N), (G22P_D103A_D104N), (G22P_D103A_D104N_S138A), (D103A_D104N_S138A), (R26G_L84F_A106V_R107H_D108N_H123Y_A142N_A143D_D147Y_E155V_I156F), (E25G_R26G_L84F_A106V_R107H_D108N_H123Y_A142N_A143D_D147Y_E155V_I 156F), (E25D_R26G_L84F_A106V_R107K_D108N_H123Y_A142N_A143G_D147Y_E155V_I 156F), (R26Q_L84F_A106V_D108N_H123Y_A142N_D147Y_E155V_I156F), (E25M_R26G_L84F_A106V_R107P_D108N_H123Y_A142N_A143D_D147Y_E155V_I 156F), (R26C_L84F_A106V_R107H_D108N_H123Y_A142N_D147Y_E155V_I156F), (L84F_A106V_D108N_H123Y_A142N_A143L_D147Y_E155V_I156F), (R26G_L84F_A106V_D108N_H123Y_A142N_D147Y_E155V_I156F), (E25A_R26G_L84F_A106V_R107N_D108N_H123Y_A142N_A143E_D147Y_E155V_I 156F), (R26G_L84F_A106V_R107H_D108N_H123Y_A142N_A143D_D147Y_E155V_I156F), (A106V_D108N_A142N_D147Y_E155V), (R26G_A106V_D108N_A142N_D147Y_E155V), (E25D_R26G_A106V_R107K_D108N_A142N_A143G_D147Y_E155V), (R26G_A106V_D108N_R107H_A142N_A143D_D147Y_E155V), (E25D_R26G_A106V_D108N_A142N_D147Y_E155V), (A106V_R107K_D108N_A142N_D147Y_E155V), (A106V_D108N_A142N_A143G_D147Y_E155V), (A106V_D108N_A142N_A143L_D147Y_E155V), (H36L_R51L_L84F_A106V_D108N_H123Y_S146C_D147Y_E155V_I156F_K157N), (N37T_P48T_M70L_L84F_A106V_D108N_H123Y_D147Y_I49V_E155V_I156F), (N37S_L84F_A106V_D108N_H123Y_D147Y_E155V_I156F_K161T), (H36L_L84F_A106V_D108N_H123Y_D147Y_Q154H_E155V_I156F), (N72S_L84F_A106V_D108N_H123Y_S146R_D147Y_E155V_1156F), (H36L_P48L_L84F_A106V_D108N_H123Y_E134G_D147Y_E155V_I156F), (H36L_L84F_A106V_D108N_H123Y_D147Y_E155V_1156F_K157N), (H36L_L84F_A106V_D108N_H123Y_S146C_D147Y_E155V_I156F), (L84F_A106V_D108N_H123Y_S146R_D147Y_E155V_I156F_K161T), (N37S_R51H_D77G_L84F_A106V_D108N_H123Y_D147Y_E155V_I156F), (R51L_L84F_A106V_D108N_H123Y_D147Y_E155V_I156F_K157N), (D24G_Q71R_L84F_H96L_A106V_D108N_H123Y_D147Y_E155V_I156F_K160E), (H36L_G67V_L84F_A106V_D108N_H123Y_S146T_D147Y_E155V_I156F), (Q71L_L84F_A106V_D108N_H123Y_L137M_A143E_D147Y_E155V_I156F), (E25G_L84F_A106V_D108N_H123Y_D147Y_E155V_I156F_Q159L), (L84F_A91T_F104I_A106V_D108N_H123Y_D147Y_E155V_I156F), (N72D_L84F_A106V_D108N_H123Y_G125A_D147Y_E155V_I156F), (P48S_L84F_S97C_A106V_D108N_H123Y_D147Y_E155V_I156F), (W23G_L84F_A106V_D108N_H123Y_D147Y_E155V_1156F), (D24G_P48L_Q71R_L84F_A106V_D108N_H123Y_D147Y_E155V_I156F_Q159L), (L84F_A106V_D108N_H123Y_A142N_D147Y_E155V_I156F), (H36L_R51L_L84F_A106V_D108N_H123Y_A142N_S146C_D147Y_E155V_I156F_K157N), (N37S_L84F_A106V_D108N_H123Y_A142N_D147Y_E155V_I156F_K161T), (L84F_A106V_D108N_D147Y_E155V_1156F), (R51L_L84F_A106V_D108N_H123Y_S146C_D147Y_E155V_I156F_K157N_K161T), (L84F_A106V_D108N_H123Y_S146C_D147Y_E155V_I156F_K161T), (L84F_A106V_D108N_H123Y_S146C_D147Y_E155V_I156F_K157N_K160E_K161T), (L84F_A106V_D108N_H123Y_S146C_D147Y_E155V_I156F_K157N_K160E), (R74Q L84F_A106V_D108N_H123Y_D147Y_E155V_I156F), (R74A_L84F_A106V_D108N_H123Y_D147Y_E155V_I156F), (L84F_A106V_D108N_H123Y_D147Y_E155V_I156F), (R74Q_L84F_A106V_D108N_H123Y_D147Y_E155V_I156F), (L84F_R98Q_A106V_D108N_H123Y_D147Y_E155V_I156F), (L84F_A106V_D108N_H123Y_R129Q_D147Y_E155V_I156F), (P48S_L84F_A106V_D108N_H123Y_A142N_D147Y_E155V_I156F), (P48S_A142N), (P48T_149V_L84F_A106V_D108N_H123Y_A142N_D147Y_E155V_I156F_L157N), (P48T_I49V_A142N), (H36L_P48S_R51L_L84F_A106V_D108N_H123Y_S146C_D147Y_E155V_I156F_K157N), (H36L_P48S_R51L_L84F_A106V_D108N_H123Y_S146C_A142N_D147Y_E155V_I156F), (H36L_P48T_149V_R51L_L84F_A106V_D108N_H123Y_S146C_D147Y_E155V_I156F_K157N), (H36L_P48T_149V_R51L_L84F_A106V_D108N_H123Y_A142N_S146C_D147Y_E155V_1156F_K157N), (H36L_P48A_R51L_L84F_A106V_D108N_H123Y_S146C_D147Y_E155V_I156F_K157N), (H36L_P48A_R51L_L84F_A106V_D108N_H123Y_A142N_S146C_D147Y_E155V_I156F_K157N), (H36L_P48A_R51L_L84F_A106V_D108N_H123Y_S146C_A142N_D147Y_E155V_I156F_K157N), (W23L_H36L_P48A_R51L_L84F_A106V_D108N_H123Y_S146C_D147Y_E155V_I156F_K157N), (W23R_H36L_P48A_R51L_L84F_A106V_D108N_H123Y_S146C_D147Y_E155V_I156F_K157N), (W23L_H36L_P48A_R51L_L84F_A106V_D108N_H123Y_S146R_D147Y_E155V_I156F_K161T), (H36L_P48A_R51L_L84F_A106V_D108N_H123Y_S146C_D147Y_R152H_E155V_I156F_K157N), (H36L_P48A_R51L_L84F_A106V_D108N_H123Y_S146C_D147Y_R152P_E155V_I156F_K157N), (W23L_H36L_P48A_R51L_L84F_A106V_D108N_H123Y_S146C_D147Y_R152P_E155V_I156F_K157N), (W23L_H36L_P48A_R51L_L84F_A106V_D108N_H123Y_A142A_S146C_D147Y_E155V_I156F_K157N), (W23L_H36L_P48A_R51L_L84F_A106V_D108N_H123Y_A142A_S146C_D147Y_R152P_E155V_I156F_K157N), (W23L_H36L_P48A_R51L_L84F_A106V_D108N_H123Y_S146R_D147Y_E155V_I156F_K161T), (W23R_H36L_P48A_R51L_L84F_A106V_D108N_H123Y_S146C_D147Y_R152P_E155V_I156F_K157N), (H36L_P48A_R51L_L84F_A106V_D108N_H123Y_A142N_S146C_D147Y_R152P_E155V_I156F_K157N).

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the adenosine deaminase comprises a D108X mutation in the TadA reference sequence, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation, or a corresponding mutation in another adenosine deaminase.

In some embodiments, the adenosine deaminase comprises an A106X, E155X, or D147X, relative to the TadA reference sequence, or a corresponding mutation in another adenosine deaminase, where X indicates any amino acid other than the corresponding amino acid in the wild-type adenosine deaminase. In some embodiments, the adenosine deaminase comprises an E155D, E155G, or E155V mutation. In some embodiments, the adenosine deaminase comprises a D147Y.

It should be appreciated that any of the mutations provided herein (e.g., based on the the TadA reference sequence amino acid sequence) can be introduced into other adenosine deaminases, such as *E. coli* TadA (ecTadA), *S. aureus* TadA (saTadA), or other adenosine deaminases (e.g., bacterial adenosine deaminases). Any of the mutations identified relative to the TadA reference sequence can be made in other adenosine deaminases that have homologous amino acid residues. It should also be appreciated that any of the mutations provided herein can be made individually or in any combination relative to the TadA reference sequence or another adenosine deaminase.

For example, an adenosine deaminase can contain a D108N, a A106V, a E155V, and/or a D147Y, or a corresponding mutation in another adenosine deaminase. In some embodiments, an adenosine deaminase comprises the following group of mutations (groups of mutations are separated by a ";") relative to the TadA reference sequence, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D147Y; and D108N, A106V, E55V, and D147Y. It should be appreciated, however, that any combination of corresponding mutations provided herein can be made in an adenosine deaminase (e.g., the TadA reference sequence or ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, MT18X, N127X, A138X, F149X, M151X, R153X, Q154X, 1156X, and/or K1157X relative to the TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, 1951, V102A, F104L, AT06V, RT07C, or RT07H, or RT07P, D108G, or D108N, or D108V, or D108A, or D108Y, K1101, M118K, N127S, A138V, F149Y, M151V, R153C, Q154L, 1156D, and/or K157R relative to the TadA reference sequence, or one or more corresponding mutations in another adenosine deaminase. In some embodiments, the adenosine deaminase comprises one or more of a H8X, D108X, and/or N127X relative to the TadA reference sequence, or one or more corresponding mutations in another adenosine deaminase, where X indicates the presence of any amino acid. In some embodiments, the adenosine deaminase comprises one or more of a H8Y, D108N, and/or N127S relative to the TadA reference sequence, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X relative to the TadA reference sequence, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P relative to the TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X relative to the TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X relative to the TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X relative to the TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H relative to the TadA reference sequence, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H relative to the TadA reference sequence, or a corresponding mutation or mutations in another adenosine deaminase. In some embodiments, the adenosine deaminase comprises one, two, three, four, or five, mutations selected from the group consisting of H8Y, D108N, N127S, E155V, and T166P relative to the TadA reference sequence, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q relative to the TadA reference sequence, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V relative to the TadA reference sequence, or a corresponding mutation or mutations in another adenosine deaminase. In some embodiments, the adenosine deaminase comprises one, two, three, four, or five, mutations selected from the group consisting of H8Y, D108N, A109T, N127S, and E155G relative to the TadA reference sequence, or a corresponding mutation or mutations in another adenosine deaminase.

Any of the mutations provided herein and any additional mutations (e.g., based on the the TadA reference sequence amino acid sequence) can be introduced into any other adenosine deaminases. Any of the mutations provided herein can be made individually or in any combination relative to the TadA reference sequence or another adenosine deaminase.

Details of A to G nucleobase editing proteins are described in International PCT Application No. PCT/2017/045381 (WO 2018/027078) and Gaudelli, N. M., et al., "Programmable base editing of A•T to G•C in genomic DNA without DNA cleavage" Nature 551, 464-471 (2017), the entire contents of which are hereby incorporated by reference.

Cytidine Deaminase

In one embodiment, a fusion protein of the invention comprises a cytidine deaminase. In some embodiments, the cytidine deaminases provided herein are capable of deaminating cytosine or 5-methylcytosine to uracil or thymine. In some embodiments, the cytosine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

Additional Domains

A base editor described herein can include any domain which helps to facilitate the nucleobase editing, modification or altering of a nucleobase of a polynucleotide. In some embodiments, a base editor comprises a polynucleotide programmable nucleotide binding domain (e.g., Cas9), a nucleobase editing domain (e.g., deaminase domain), and one or more additional domains. In some cases, the additional domain can facilitate enzymatic or catalytic functions of the base editor, binding functions of the base editor, or be inhibitors of cellular machinery (e.g., enzymes) that could interfere with the desired base editing result. In some embodiments, a base editor can comprise a nuclease, a nickase, a recombinase, a deaminase, a methyltransferase, a methylase, an acetylase, an acetyltransferase, a transcriptional activator, or a transcriptional repressor domain.

In some embodiments, a base editor can comprise a uracil glycosylase inhibitor (UGI) domain. A UGI domain can for example improve the efficiency of base editors comprising a cytidine deaminase domain by inhibiting the conversion of a U formed by deamination of a C back to the C nucleobase. In some cases, cellular DNA repair response to the presence of U:G heteroduplex DNA can be responsible for a decrease in nucleobase editing efficiency in cells. In such cases, uracil DNA glycosylase (UDG) can catalyze removal of U from DNA in cells, which can initiate base excision repair (BER), mostly resulting in reversion of the U:G pair to a C:G pair. In such cases, BER can be inhibited in base editors comprising one or more domains that bind the single strand, block the edited base, inhibit UGI, inhibit BER, protect the edited base, and/or promote repairing of the non-edited strand. Thus, this disclosure contemplates a base editor fusion protein comprising a UGI domain.

In some embodiments, a base editor comprises as a domain all or a portion of a double-strand break (DSB) binding protein. For example, a DSB binding protein can include a Gam protein of bacteriophage Mu that can bind to the ends of DSBs and can protect them from degradation. See Komor, A. C., et al., "Improved base excision repair inhibition and bacteriophage Mu Gam protein yields C:G-to-T:A base editors with higher efficiency and product purity" Science Advances 3:eaao4774 (2017), the entire content of which is hereby incorporated by reference.

In some embodiments, a base editor can comprise as a domain all or a portion of a nucleic acid polymerase (NAP). For example, a base editor can comprise all or a portion of a eukaryotic NAP. In some embodiments, a NAP or portion thereof incorporated into a base editor is a DNA polymerase. In some embodiments, a NAP or portion thereof incorporated into a base editor has translesion polymerase activity. In some cases, a NAP or portion thereof incorporated into a base editor is a translesion DNA polymerase. In some embodiments, a NAP or portion thereof incorporated into a base editor is a Rev7, RevI complex, polymerase iota, polymerase kappa, or polymerase eta. In some embodiments, a NAP or portion thereof incorporated into a base editor is a eukaryotic polymerase alpha, beta, gamma, delta, epsilon, gamma, eta, iota, kappa, lambda, mu, or nu component. In some embodiments, a NAP or portion thereof incorporated into a base editor comprises an amino acid sequence that is at least 75%, 80%, 85%, 90%, 95%, 96%, 97%, 98%, 99%, or 99.5% identical to a nucleic acid polymerase (e.g., a translesion DNA polymerase).

Base Editor System

Use of the base editor system provided herein comprises the steps of (a) contacting a target nucleotide sequence of a polynucleotide (e.g., a double-stranded DNA or RNA, a single-stranded DNA or RNA) of a subject with a base editor system comprising a nucleobase editor (e.g., an adenosine base editor or a cytidine base editor) and a guide polynucleic acid (e.g., gRNA), wherein the target nucleotide sequence comprises a targeted nucleobase pair; (b) inducing strand separation of said target region; (c) converting a first nucleobase of said target nucleobase pair in a single strand of the target region to a second nucleobase; and (d) cutting no more than one strand of said target region, where a third nucleobase complementary to the first nucleobase base is replaced by a fourth nucleobase complementary to the second nucleobase. It should be appreciated that in some embodiments, step (b) is omitted. In some embodiments, said targeted nucleobase pair is a plurality of nucleobase pairs in one or more genes. In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more genes, wherein at least one gene is located in a different locus.

In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine.

Base editing system as provided herein provides anew approach to genome editing that uses a fusion protein containing a catalytically defective *Streptococcus pyogenes* Cas9, a cytidine deaminase, and an inhibitor of base excision repair to induce programmable, single nucleotide (C→T or A→G) changes in DNA without generating double-strand DNA breaks, without requiring a donor DNA template, and without inducing an excess of stochastic insertions and deletions.

Provided herein are systems, compositions, and methods for editing a nucleobase using a base editor system. In some embodiments, the base editor system comprises (1) a base editor (BE) comprising a polynucleotide programmable nucleotide binding domain and a nucleobase editing domain (e.g., a deaminase domain) for editing the nucleobase; and (2) a guide polynucleotide (e.g., guide RNA) in conjunction with the polynucleotide programmable nucleotide binding domain. In some embodiments, the base editor system comprises a cytosine base editor (CBE). In some embodiments, the base editor system comprises an adenosine base editor (ABE). In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the nucleobase editing domain is a deaminase domain. In some cases, a deaminase domain can be a cytosine deaminase or a cytidine deaminase. In some embodiments, the terms "cytosine deaminase" and "cytidine deaminase" can be used interchangeably. In some cases, a deaminase domain can be an adenine deaminase or an adenosine deaminase. In some embodiments, the terms "adenine deaminase" and "adenosine deaminase" can be used interchangeably. Details of nucleobase editing proteins are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, the base editor inhibits base excision repair of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edit of base pair is upstream of a PAM site. In some embodiments, the intended edit of base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edit of base-pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site.

In some embodiments, the method does not require a canonical (e.g., NGG) PAM site. In some embodiments, the nucleobase editor comprises a linker or a spacer. In some embodiments, the linker or spacer is 1-25 amino acids in length. In some embodiments, the linker or spacer is 5-20 amino acids in length. In some embodiments, the linker or spacer is 10, 11, 12, 13, 14, 15, 16, 17, 18, 19, or 20 amino acids in length.

In some embodiments, the target region comprises a target window, wherein the target window comprises the target nucleobase pair. In some embodiments, the target window comprises 1-10 nucleotides. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edit of base pair is within the target window. In some embodiments, the target window comprises the intended edit of base pair. In some embodiments, the method is performed using any of the base editors provided herein. In some embodiments, a target window is a deamination window.

In some embodiments, the base editor is a cytidine base editor (CBE). In some embodiments, non-limiting exemplary CBE is BET (APOBECT-XTEN-dCas9), BE2 (APOBEC1-XTEN-dCas9-UGI), BE3 (APOBEC1-XTEN-dCas9(A840H)-UGI), BE3-Gam, saBE3, saBE4-Gam, BE4, BE4-Gam, saBE4, or saB4E-Gam. BE4 extends the APOBECl-Cas9n(D10A) linker to 32 amino acids and the Cas9n-UGI linker to 9 amino acids, and appends a second copy of UGI to the C terminus of the construct with another 9-amino acid linker into a single base editor construct. The base editors saBE3 and saBE4 have the *S. pyogenes* Cas9n (D10A) replaced with the smaller *S. aureus* Cas9n(D10A). BE3-Gam, saBE3-Gam, BE4-Gam, and saBE4-Gam have 174 residues of Gam protein fused to the N-terminus of BE3, saBE3, BE4, and saBE4 via the 16 amino acid XTEN linker.

In some embodiments, the base editor is an adenosine base editor (ABE). In some embodiments, the adenosine base editor can deaminate adenine in DNA. In some embodiments, ABE is generated by replacing APOBEC1 component of BE3 with natural or engineered *E. coli* TadA, human ADAR2, mouse ADA, or human ADAT2. In some embodiments, ABE comprises evolved TadA variant. In some embodiments, the ABE is ABE 1.2 (TadA*-XTEN-nCas9-NLS). In some embodiments, TadA* comprises A106V and D108N mutations.

In some embodiments, the ABE is a second-generation ABE. In some embodiments, the ABE is ABE2.1, which comprises additional mutations D147Y and E155V in TadA* (TadA*2.1). In some embodiments, the ABE is ABE2.2, ABE2.1 fused to catalytically inactivated version of human alkyl adenine DNA glycosylase (AAG with E125Q mutation). In some embodiments, the ABE is ABE2.3, ABE2.1 fused to catalytically inactivated version of *E. coli* Endo V (inactivated with D35A mutation). In some embodiments, the ABE is ABE2.6 which has a linker twice as long (32 amino acids, $(SGGS)_2$-XTEN-$(SGGS)_2$ ("$(SGGS)_2$" disclosed as SEQ ID NO: 126)) as the linker in ABE2.1. In some embodiments, the ABE is ABE2.7, which is ABE2.1 tethered with an additional wild-type TadA monomer. In some embodiments, the ABE is ABE2.8, which is ABE2.1 tethered with an additional TadA*2.1 monomer. In some embodiments, the ABE is ABE2.9, which is a direct fusion of evolved TadA (TadA*2.1) to the N-terminus of ABE2.1. In some embodiments, the ABE is ABE2.10, which is a direct fusion of wild type TadA to the N-terminus of ABE2.1. In some embodiments, the ABE is ABE2.11, which is ABE2.9 with an inactivating E59A mutation at the N-terminus of TadA* monomer. In some embodiments, the ABE is ABE2.12, which is ABE2.9 with an inactivating E59A mutation in the internal TadA* monomer.

In some embodiments, the ABE is a third generation ABE. In some embodiments, the ABE is ABE3.1, which is ABE2.3 with three additional TadA mutations (L84F, H123Y, and I157F).

In some embodiments, the ABE is a fourth generation ABE. In some embodiments, the ABE is ABE4.3, which is ABE3.1 with an additional TadA mutation A142N (TadA*4.3).

In some embodiments, the ABE is a fifth generation ABE. In some embodiments, the ABE is ABE5.1, which is generated by importing a consensus set of mutations from surviving clones (H36L, R51L, S146C, and K157N) into ABE3.1. In some embodiments, the ABE is ABE5.3, which has a heterodimeric construct containing wild-type *E. coli* TadA fused to an internal evolved TadA*. In some embodiments, the ABE is ABE5.2, ABE5.4, ABE5.5, ABE5.6, ABE5.7, ABE5.8, ABE5.9, ABE5.10, ABE5.11, ABE5.12, ABE5.13, or ABE5.14, as shown in below Table 2. In some embodiments, the ABE is a sixth generation ABE. In some embodiments, the ABE is ABE6.1, ABE6.2, ABE6.3, ABE6.4, ABE6.5, or ABE6.6, as shown in below Table 2. In some embodiments, the ABE is a seventh generation ABE. In some embodiments, the ABE is ABE7.1, ABE7.2, ABE7.3, ABE7.4, ABE7.5, ABE7.6, ABE7.7, ABE7.8, ABE 7.9, or ABE7.10, as shown in below Table 2.

TABLE 2

| Genotypes of ABEs | | | | | | | | | | | | | | | | | | | | | | |
|---|---|---|---|---|---|---|---|---|---|---|---|---|---|---|---|---|---|---|---|---|---|---|
| | 23 | 26 | 36 | 37 | 48 | 49 | 51 | 72 | 84 | 87 | 105 | 108 | 123 | 125 | 142 | 145 | 147 | 152 | 155 | 156 | 157 | 16 |
| ABE0.1 | W | R | H | N | P | | R | N | L | S | A | D | H | G | A | S | D | R | E | I | K | K |
| ABE0.2 | W | R | H | N | P | | R | N | L | S | A | D | H | G | A | S | D | R | E | I | K | K |
| ABE1.1 | W | R | H | N | P | | R | N | L | S | A | N | H | G | A | S | D | R | E | I | K | K |
| ABE1.2 | W | R | H | N | P | | R | N | L | S | V | N | H | G | A | S | D | R | E | I | K | K |
| ABE2.1 | W | R | H | N | P | | R | N | L | S | V | N | H | G | A | S | Y | R | V | I | K | K |
| ABE2.2 | W | R | H | N | P | | R | N | L | S | V | N | H | G | A | S | Y | R | V | I | K | K |
| ABE2.3 | W | R | H | N | P | | R | N | L | S | V | N | H | G | A | S | Y | R | V | I | K | K |
| ABE2.4 | W | R | H | N | P | | R | N | L | S | V | N | H | G | A | S | Y | R | V | I | K | K |
| ABE2.5 | W | R | H | N | P | | R | N | L | S | V | N | H | G | A | S | Y | R | V | I | K | K |
| ABE2.6 | W | R | H | N | P | | R | N | L | S | V | N | H | G | A | S | Y | R | V | I | K | K |
| ABE2.7 | W | R | H | N | P | | R | N | L | S | V | N | H | G | A | S | Y | R | V | I | K | K |
| ABE2.8 | W | R | H | N | P | | R | N | L | S | V | N | H | G | A | S | Y | R | V | I | K | K |
| ABE2.9 | W | R | H | N | P | | R | N | L | S | V | N | H | G | A | S | Y | R | V | I | K | K |
| ABE2.10 | W | R | H | N | P | | R | N | L | S | V | N | H | G | A | S | Y | R | V | I | K | K |
| ABE2.11 | W | R | H | N | P | | R | N | L | S | V | N | H | G | A | S | Y | R | V | I | K | K |
| ABE2.12 | W | R | H | N | P | | R | N | L | S | V | N | H | G | A | S | Y | R | V | I | K | K |
| ABE3.1 | W | R | H | N | P | | R | N | F | S | V | N | Y | G | A | S | Y | R | V | F | K | K |
| ABE3.2 | W | R | H | N | P | | R | N | F | S | V | N | Y | G | A | S | Y | R | V | F | K | K |
| ABE3.3 | W | R | H | N | P | | R | N | F | S | V | N | Y | G | A | S | Y | R | V | F | K | K |
| ABE3.4 | W | R | H | N | P | | R | N | F | S | V | N | Y | G | A | S | Y | R | V | F | K | K |
| ABE3.5 | W | R | H | N | P | | R | N | F | S | V | N | Y | G | A | S | Y | R | V | F | K | K |
| ABE3.6 | W | R | H | N | P | | R | N | F | S | V | N | Y | G | A | S | Y | R | V | F | K | K |
| ABE3.7 | W | R | H | N | P | | R | N | F | S | V | N | Y | G | A | S | Y | R | V | F | K | K |
| ABE3.8 | W | R | H | N | P | | R | N | F | S | V | N | Y | G | A | S | Y | R | V | F | K | K |
| ABE4.1 | W | R | H | N | P | | R | N | L | S | V | N | H | G | N | S | Y | R | V | I | K | K |
| ABE4.2 | W | G | H | N | P | | R | N | L | S | V | N | H | G | N | S | Y | R | V | I | K | K |
| ABE4.3 | W | R | H | N | P | | R | N | F | S | V | N | Y | G | N | S | Y | R | V | F | K | K |
| ABE5.1 | W | R | L | N | P | | L | N | F | S | V | N | Y | G | A | C | Y | R | V | F | N | K |
| ABE5.2 | W | R | H | S | P | | R | N | F | S | V | N | Y | G | A | S | Y | R | V | F | K | T |
| ABE5.3 | W | R | L | N | P | | L | N | I | S | V | N | Y | G | A | C | Y | R | V | I | N | K |
| ABE5.4 | W | R | H | S | P | | R | N | F | S | V | N | Y | G | A | S | Y | R | V | F | K | T |

TABLE 2-continued

| Genotypes of ABEs | | | | | | | | | | | | | | | | | | | | | | |
|---|---|---|---|---|---|---|---|---|---|---|---|---|---|---|---|---|---|---|---|---|---|---|
| | 23 | 26 | 36 | 37 | 48 | 49 | 51 | 72 | 84 | 87 | 105 | 108 | 123 | 125 | 142 | 145 | 147 | 152 | 155 | 156 | 157 | 16 |
| ABE5.5 | W | R | L | N | P | | L | N | F | S | V | N | Y | G | A | C | Y | R | V | F | N | K |
| ABE5.6 | W | R | L | N | P | | L | N | F | S | V | N | Y | G | A | C | Y | R | V | F | N | K |
| ABE5.7 | W | R | L | N | P | | L | N | F | S | V | N | Y | G | A | C | Y | R | V | F | N | K |
| ABE5.8 | W | R | L | N | P | | L | N | F | S | V | N | Y | G | A | C | Y | R | V | F | N | K |
| ABE5.9 | W | R | L | N | P | | L | N | F | S | V | N | Y | G | A | C | Y | R | V | F | N | K |
| ABE5.10 | W | R | L | N | P | | L | N | F | S | V | N | Y | G | A | C | Y | R | V | F | N | K |
| ABE5.11 | W | R | L | N | P | | L | N | F | S | V | N | Y | G | A | C | Y | R | V | F | N | K |
| ABE5.12 | W | R | L | N | P | | L | N | F | S | V | N | Y | G | A | C | Y | R | V | F | N | K |
| ABE5.13 | W | R | H | N | P | | L | D | F | S | V | N | Y | A | A | S | Y | R | V | F | K | K |
| ABE5.14 | W | R | H | N | S | | L | N | F | C | V | N | Y | G | A | S | Y | R | V | F | K | K |
| ABE6.1 | W | R | H | N | S | | L | N | F | S | V | N | Y | G | N | S | Y | R | V | F | K | K |
| ABE6.2 | W | R | H | N | T | V | L | N | F | S | V | N | Y | G | N | S | Y | R | V | F | N | K |
| ABE6.3 | W | R | L | N | S | | L | N | F | S | V | N | Y | G | A | C | Y | R | V | F | N | K |
| ABE6.4 | W | R | L | N | S | | L | N | F | S | V | N | Y | G | N | C | Y | R | V | F | N | K |
| ABE6.5 | W | R | L | N | I | V | L | N | F | S | V | N | Y | G | A | C | Y | R | V | F | N | K |
| ABE6.6 | W | R | L | N | T | V | L | N | F | S | V | N | Y | G | N | C | Y | R | V | F | N | K |
| ABE7.1 | W | R | L | N | A | | L | N | F | S | V | N | Y | G | A | C | Y | R | V | F | N | K |
| ABE7.2 | W | R | L | N | A | | L | N | F | S | V | N | Y | G | N | C | Y | R | V | F | N | K |
| ABE7.3 | I | R | L | N | A | | L | N | F | S | V | N | Y | G | A | C | Y | R | V | F | N | K |
| ABE7.4 | R | R | L | N | A | | L | N | F | S | V | N | Y | G | A | C | Y | R | V | F | N | K |
| ABE7.5 | W | R | L | N | A | | L | N | F | S | V | N | Y | G | A | C | Y | H | V | F | N | K |
| ABE7.6 | W | R | L | N | A | | L | N | I | S | V | N | Y | G | A | C | Y | P | V | I | N | K |
| ABE7.7 | L | R | L | N | A | | L | N | F | S | V | N | Y | G | A | C | Y | P | V | F | N | K |
| ABE7.8 | I | R | L | N | A | | L | N | F | S | V | N | Y | G | N | C | Y | R | V | F | N | K |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

In some embodiments, the base editor is a fusion protein comprising a polynucleotide programmable nucleotide binding domain (e.g., Cas9-derived domain) fused to a nucleobase editing domain (e.g., all or a portion of a deaminase domain). In some embodiments, the base editor further comprises a domain comprising all or a portion of a uracil glycosylase inhibitor (UGI). In some embodiments, the base editor comprises a domain comprising all or a portion of a uracil binding protein (UBP), such as a uracil DNA glycosylase (UDG). In some embodiments, the base editor comprises a domain comprising all or a portion of a nucleic acid polymerase. In some embodiments, a nucleic acid polymerase or portion thereof incorporated into a base editor is a translesion DNA polymerase.

In some embodiments, a domain of the base editor can comprise multiple domains. For example, the base editor comprising a polynucleotide programmable nucleotide binding domain derived from Cas9 can comprise an REC lobe and an NUC lobe corresponding to the REC lobe and NUC lobe of a wild-type or natural Cas9. In another example, the base editor can comprise one or more of a RuvCI domain, BH domain, REC1 domain, REC2 domain, RuvCII domain, Li domain, HNH domain, L2 domain, RuvCIII domain, WED domain, TOPO domain or CTD domain. In some embodiments, one or more domains of the base editor comprise a mutation (e.g., substitution, insertion, deletion) relative to a wild type version of a polypeptide comprising the domain. For example, an HNH domain of a polynucleotide programmable DNA binding domain can comprise an H840A substitution. In another example, a RuvCI domain of a polynucleotide programmable DNA binding domain can comprise a D10A substitution.

Different domains (e.g. adjacent domains) of the base editor disclosed herein can be connected to each other with or without the use of one or more linker domains (e.g. an XTEN linker domain). In some cases, a linker domain can be a bond (e.g., covalent bond), chemical group, or a molecule linking two molecules or moieties, e.g., two domains of a fusion protein, such as, for example, a first domain (e.g., Cas9-derived domain) and a second domain (e.g., a cytidine deaminase domain or adenosine deaminase domain). In some embodiments, a linker is a covalent bond (e.g., a carbon-carbon bond, disulfide bond, carbon-hetero atom bond, etc.). In certain embodiments, a linker is a carbon nitrogen bond of an amide linkage. In certain embodiments, a linker is a cyclic or acyclic, substituted or unsubstituted, branched or unbranched aliphatic or heteroaliphatic linker. In certain embodiments, a linker is polymeric (e.g., polyethylene, polyethylene glycol, polyamide, polyester, etc.). In certain embodiments, a linker comprises a monomer, dimer, or polymer of aminoalkanoic acid. In some embodiments, a linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, a linker comprises a monomer, dimer, or polymer of aminohexanoic acid (Ahx). In certain embodiments, a linker is based on a carbocyclic moiety (e.g., cyclopentane, cyclohexane). In other embodiments, a linker comprises a polyethylene glycol moiety (PEG). In certain embodiments, a linker comprises an aryl or heteroaryl moiety. In certain embodiments, the linker is based on a phenyl ring. A linker can include functionalized moieties to facilitate attachment of a nucleophile (e.g., thiol, amino) from the peptide to the linker. Any electrophile can be used as part of the linker. Exemplary electrophiles include, but are not limited to, activated esters, activated amides, Michael acceptors, alkyl halides, aryl halides, acyl halides, and isothiocyanates. In some embodiments, a linker joins a gRNA binding domain of an RNA-programmable nuclease, including a Cas9 nuclease domain, and the catalytic domain of a nucleic acid editing protein. In some embodiments, a linker joins a dCas9 and a second domain (e.g., cytidine deaminase, UGI, etc.).

Typically, a linker is positioned between, or flanked by, two groups, molecules, or other moieties and connected to each one via a covalent bond, thus connecting the two. In some embodiments, a linker is an amino acid or a plurality of amino acids (e.g., a peptide or protein). In some embodiments, a linker is an organic molecule, group, polymer, or chemical moiety. In some embodiments, a linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length. Longer or shorter linkers are also contemplated. In some embodiments, a linker domain comprises the amino acid sequence SGSETPGTSESATPES (SEQ ID NO: 7), which can also be referred to as the XTEN linker. Any method for linking the fusion protein domains can be employed (e.g., ranging from very flexible linkers of the form $(SGGS)_n$ (SEQ ID NO: 8), $(GGGS)_n$ (SEQ ID NO: 127), $(GGGGS)_n$ (SEQ ID NO: 128), and $(G)_n$, to more rigid linkers of the form $(EAAAK)_n$ (SEQ ID NO: 129), $(GGS)_n$, SGSETPGTSESATPES (SEQ ID NO: 7) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference), or $(XP)_n$ motif, in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif, wherein n is 1, 3, or 7 (SEQ ID NO: 130). In some embodiments, the Cas9 domain of the fusion proteins provided herein are fused via a linker comprising the amino acid sequence SGSETPGTSESATPES (SEQ ID NO: 7). In some embodiments, a linker comprises a plurality of proline residues and is 5-21, 5-14, 5-9, 5-7 amino acids in length, e.g., PAPAP (SEQ ID NO: 16), PAPAPA (SEQ ID NO: 17), PAPAPAP (SEQ ID NO: 18), PAPAPAPA (SEQ ID NO: 19), $P(AP)_4$ (SEQ ID NO: 20), $P(AP)_7$ (SEQ ID NO: 21), $P(AP)_{10}$ (SEQ ID NO: 22) (see, e.g., Tan J, Zhang F, Karcher D, Bock R. Engineering of high-precision base editors for site-specific single nucleotide replacement. Nat Commun. 2019 Jan. 25; 10(1):439; the entire contents are incorporated herein by reference). Such proline-rich linkers are also termed "rigid" linkers.

A fusion protein of the invention comprises a nucleic acid editing domain. In some embodiments, the nucleic acid editing domain can catalyze a C to U base change. In some embodiments, the nucleic acid editing domain is a deaminase domain. In some embodiments, the deaminase is a cytidine deaminase or an adenosine deaminase. In some embodiments, the deaminase is an apolipoprotein B mRNA-editing complex (APOBEC) family deaminase. In some embodiments, the deaminase is an APOBECI deaminase. In some embodiments, the deaminase is an APOBEC2 deaminase. In some embodiments, the deaminase is an APOBEC3 deaminase. In some embodiments, the deaminase is an APOBEC3 A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deaminase is a human APOBEC3G. In some embodiments, the deaminase is a fragment of the human APOBEC3G. In some embodiments, the deaminase is a human APOBEC3G variant comprising a D316R_D317R mutation. In some embodiments, the deaminase is a fragment of the human APOBEC3G and comprising mutations corresponding to the D316R D317R mutations. In some embodiments, the nucleic acid editing domain is at least 80%, at least 85%, at least 90%, at least 92%, at least 95%, at least 96%, at least 97%, at least 98%, at least 99%), or at least 99.5% identical to the deaminase domain of any deaminase described herein.

Cas9 Complexes with Guide RNAs

Some aspects of this disclosure provide complexes comprising any of the fusion proteins provided herein, and a guide RNA (e.g., a guide that targets an Mecp2 allele bearing RTT targetable mutations).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 1 or 5'-NAA-3'). In some embodiments, the guide nucleic acid (e.g., guide RNA) is complementary to a sequence in Mecp2 allele bearing RTT targetable mutations.

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NAA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas9 binding, and a guide sequence, which confers sequence specificity to the Cas9: nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

The domains of the base editor disclosed herein can be arranged in any order. Non-limiting examples of a base editor comprising a fusion protein comprising e.g., a polynucleotide-programmable nucleotide-binding domain and a deaminase domain can be arranged as following:

$NH_2$-[nucleobase editing domain]-Linker1-[e.g., Cas9 derived domain]-COOH;

$NH_2$-[e.g., adenosine deaminase]-Linker1-[e.g., Cas9 derived domain]-COOH;

$NH_2$-[e.g., adenosine deaminase]-Linker1-[e.g., Cas9 derived domain]-Linker2-[UGI]-COOH;

$NH_2$-[e.g., TadA7.10]-Linker1-[e.g., Cas9 derived domain]-COOH;

$NH_2$-[e.g., adenosine deaminase]-Linker1-[e.g., Cas9 derived domain]-COOH;

$NH_2$-[e.g., TadA7.10]-Linker1-[e.g., Cas9 derived domain]-COOH;

$NH_2$-[e.g., TadA7.10]-Linker1-[e.g., Cas9 derived domain]-Linker2-[UGI]-COOH $NH_2$-[e.g., adenosine deaminase]-[e.g., Cas9 derived domain]-COOH;

$NH_2$-[e.g., Cas9 derived domain]-[e.g., adenosine deaminase]-COOH;

$NH_2$-[e.g., adenosine deaminase]-[e.g., Cas9 derived domain]-[inosine BER inhibitor]-COOH;

$NH_2$-[e.g., adenosine deaminase]-[inosine BER inhibitor]-[e.g., Cas9 derived domain]-COOH;

$NH_2$-[inosine BER inhibitor]-[e.g., adenosine deaminase]-[e.g., Cas9 derived domain]-COOH;

$NH_2$-[e.g., Cas9 derived domain]-[e.g., adenosine deaminase]-[inosine BER inhibitor]-COOH;

$NH_2$-[e.g., Cas9 derived domain]-[inosine BER inhibitor]-[e.g., adenosine deaminase]-COOH; or $NH_2$-[inosine BER inhibitor]-[e.g., Cas9 derived domain]-[e.g., adenosine deaminase]-COOH.

Additionally, in some cases, a Gam protein can be fused to an N terminus of a base editor. In some cases, a Gam protein can be fused to a C terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See. Komor, A. C., et al., "Improved base excision repair inhibition and bacteriophage Mu Gam protein yields C:G-to-T:A base editors with higher efficiency and product purity" Science Advances 3:eaao4774 (2017). In some cases, a mutation or mutations can change the length of a base editor domain relative to a wild type domain. For example, a deletion of at least one amino acid in at least one domain can reduce the length of the base editor. In another case, a mutation or mutations do not change the length of a domain relative to a wild type domain. For example, substitution(s) in any domain does/do not change the length of the base editor Non-limiting examples of such base editors, where the length of all the domains is the same as the wild type domains, can include:

$NH_2$-[APOBEC1]-Linker1-[Cas9(D10A)]-Linker2-[UGI]-COOH;

$NH_2$-[CDA1]-Linker1-[Cas9(D10A)]-Linker2-[UGI]-COOH;

$NH_2$-[AID]-Linker1-[Cas9(D10A)]-Linker2-[UGI]-COOH;

$NH_2$-[APOBEC1]-Linker1-[Cas9(D10A)]-Linker2-[SSB]-COOH;

$NH_2$-[UGI]-Linker1-[ABOBEC1]-Linker2-[Cas9(D10A)]-COOH;

$NH_2$-[APOBEC1]-Linker1-[Cas9(D10A)]-Linker2-[UGI]-Linker3-[UGI]-COOH;

$NH_2$-[Cas9(D10A)]-Linker1-[CDA1]-Linker2-[UGI]-COOH;

$NH_2$-[Gam]-Linker1-[APOBEC1]-Linker2-[Cas9(D10A)]-Linker3-[UGI]-COOH;

$NH_2$-[Gam]-Linker1-[APOBEC1]-Linker2-[Cas9(D10A)]-Linker3-[UGI]-Linker4-[UGI]-COOH;

$NH_2$-[APOBEC1]-Linker1-[dCas9(D10A, H840A)]-Linker2-[UGI]-COOH; or $NH_2$-[APOBEC1]-Linker1-[dCas9(D10A, H840A)]-COOH.

In some embodiments, the base editing fusion proteins provided herein need to be positioned at a precise location, for example, where a target base is placed within a defined region (e.g., a "deamination window"). In some cases, a target can be within a 4 base region. In some cases, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A defined target region can be a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a polynucleotide programmable nucleotide binding domain. In some embodiments, an NLS of the base editor is localized C-terminal to a polynucleotide programmable nucleotide binding domain.

Other exemplary features that can be present in a base editor as disclosed herein are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Non-limiting examples of protein domains which can be included in the fusion protein include a deaminase domain (e.g., cytidine deaminase and/or adenosine deaminase), a uracil glycosylase inhibitor (UGI) domain, epitope tags, reporter gene sequences, and/or protein domains having one or more of the following activities: methylase activity, demethylase activity, transcription activation activity, transcription repression activity, transcription release factor activity, histone modification activity, RNA cleavage activity, and nucleic acid binding activity. Additional domains can be a heterologous functional domain. Such heterologous functional domains can confer a function activity, such as DNA methylation, DNA damage, DNA repair, modification of a target polypeptide associated with target DNA (e.g., a histone, a DNA-binding protein, etc.), leading to, for example, histone methylation, histone acetylation, histone ubiquitination, and the like.

Other functions conferred can include methyltransferase activity, demethylase activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, remodeling activity, protease activity, oxidoreductase activity, transferase activity, hydrolase activity, lyase activity, isomerase activity, synthase activity, synthetase activity, and demyristoylation activity, or any combination thereof.

Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BPT6 protein fusions.

Base Editor Efficiency

CRISPR-Cas9 nucleases have been widely used to mediate targeted genome editing. In most genome editing applications, Cas9 forms a complex with a guide polynucleotide (e.g., single guide RNA (sgRNA)) and induces a double-stranded DNA break (DSB) at the target site specified by the sgRNA sequence. Cells primarily respond to this DSB through the non-homologous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR). Unfortunately, under most non-perturbative conditions HDR is inefficient, dependent on cell state and cell type, and dominated by a larger frequency of indels. As most of the known genetic variations associated with human disease are point mutations, methods that can more efficiently and cleanly make precise point mutations are needed. Base editing system as provided herein provides a new way to edit genome editing without generating double-strand DNA breaks, without requiring a donor DNA template, and without inducing an excess of stochastic insertions and deletions.

The base editors provided herein are capable of modifying a specific nucleotide base without generating a significant proportion of indels. The term "indel(s)", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g., mutate or deaminate) a specific nucleotide within a nucleic acid, without generating a large number of insertions or deletions (i.e., indels) in the target nucleotide sequence. In certain embodiments, any of the base editors provided herein are capable of generating a greater proportion of intended modifications (e.g., point mutations or deaminations) versus indels.

In some embodiments, any of base editor system provided herein results in less than 50%, less than 40%, less than 30%, less than 20%, less than 19%, less than 18%, less than 17%, less than 16%, less than 15%, less than 14%, less than 13%, less than 12%, less than 110, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations.

In some embodiments, any of the base editors provided herein are capable of generating at least 0.01% of intended mutations (i.e. at least 0.01% base editing efficiency). In some embodiments, any of the base editors provided herein are capable of generating at least 0.01%, 1%, 2%, 3%, 4%, 5%, 10%, 15%, 20%, 25%, 30%, 40%, 45%, 50%, 60%, 70%, 80%, 90%, 95%, or 99% of intended mutations.

In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 8.5:1, at least 9:1, at least 10:1, at least 11:1, at least 12:1, at least 13:1, at least 14:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more.

The number of intended mutations and indels can be determined using any suitable method, for example, as described in International PCT Application Nos. PCT/2017/045381 (WO 2018/027078) and PCT/US2016/058344 (WO 2017/070632); Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017); the entire contents of which are hereby incorporated by reference.

In some embodiments, to calculate indel frequencies, sequencing reads are scanned for exact matches to two 10-bp sequences that flank both sides of a window in which indels can occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively. In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor.

The number of indels formed at a target nucleotide region can depend on the amount of time a nucleic acid (e.g., a nucleic acid within the genome of a cell) is exposed to a base editor. In some embodiments, the number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing the target nucleotide sequence (e.g., a nucleic acid within the genome of a cell) to a base editor. It should be appreciated that the characteristics of the base editors as described herein can be applied to any of the fusion proteins, or methods of using the fusion proteins provided herein.

Multiplex Editing

In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more gene, wherein at least one gene is located in a different locus. In some embodiments, the multiplex editing can comprise one or more guide polynucleotides. In some embodiments, the multiplex editing can comprise one or more base editor system. In some embodiments, the multiplex editing can comprise one or more base editor systems with a single guide polynucleotide. In some embodiments, the multiplex editing can comprise one or more base editor system with a plurality of guide polynucleotides. In some embodiments, the multiplex editing can comprise one or more guide polynucleotide with a single base editor system. In some embodiments, the multiplex editing can comprise at least one guide polynucleotide that does not require a PAM sequence to target binding to a target polynucleotide sequence. In some embodiments, the multiplex editing can comprise at least one guide polynucleotide that require a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editor provided herein. It should also be appreciated that the multiplex editing using any of the base editors as described herein can comprise a sequential editing of a plurality of nucleobase pairs.

The methods provided herein comprises the steps of: (a) contacting a target nucleotide sequence of a polynucleotide of a subject (e.g., a double-stranded DNA sequence) with a base editor system comprising a nucleobase editor (e.g., an adenosine base editor or a cytidine base editor) and a guide polynucleic acid (e.g., gRNA), wherein the target nucleotide sequence comprises a targeted nucleobase pair; (b) inducing strand separation of said target region; (c) editing a first nucleobase of said target nucleobase pair in a single strand of the target region to a second nucleobase; and (d) cutting no more than one strand of said target region, where a third nucleobase complementary to the first nucleobase base is replaced by a fourth nucleobase complementary to the second nucleobase.

In some embodiments, said plurality of nucleobase pairs are in one more genes. In some embodiments, said plurality of nucleobase pairs are in the same gene. In some embodiments, at least one gene in said one more genes is located in a different locus.

In some embodiments, said editing is editing of said plurality of nucleobase pairs in at least one protein coding region. In some embodiments, said editing is editing of said plurality of nucleobase pairs in at least one protein non-coding region. In some embodiments, said editing is editing of said plurality of nucleobase pairs in at least one protein coding region and at least one protein non-coding region.

In some embodiments, said editing is in conjunction with one or more guide polynucleotides. In some embodiments, said base editor system can comprise one or more base editor system. In some embodiments, said base editor system can comprise one or more base editor systems in conjunction with a single guide polynucleotide. In some embodiments, said base editor system can comprise one or more base editor system in conjunction with a plurality of guide polynucleotides. In some embodiments, said editing is in conjunction with one or more guide polynucleotide with a single base editor system. In some embodiments, said editing is in conjunction with at least one guide polynucleotide that does not require a PAM sequence to target binding to a target polynucleotide sequence. In some embodiments, said editing is in conjunction with at least one guide polynucleotide that require a PAM sequence to target binding to a target polynucleotide sequence. In some embodiments, said editing is in conjunction with a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that said editing can comprise a sequential editing of a plurality of nucleobase pairs.

Methods of Using Base Editors

The correction of point mutations in disease-associated genes and alleles provides new strategies for gene correction with applications in therapeutics and basic research.

The present disclosure provides methods for the treatment of a subject diagnosed with a disease associated with or caused by a point mutation that can be corrected by a base editor system provided herein. For example, in some embodiments, a method is provided that comprises administering to a subject having such a disease, e.g., a disease caused by a genetic mutation, an effective amount of a nucleobase editor (e.g., an adenosine deaminase base editor or a cytidine deaminase base editor) that corrects the point mutation in the disease associated gene. The present disclosure provides methods for the treatment of RTT that are associated or caused by a point mutation that can be corrected by deaminase mediated gene editing. Some such diseases are described herein, and additional suitable diseases that can be treated with the strategies and fusion proteins provided herein will be apparent to those of skill in the art based on the instant disclosure. It will be understood that the numbering of the specific positions or residues in the respective sequences depends on the particular protein and numbering scheme used. Numbering can be different, e.g., in precursors of a mature protein and the mature protein itself, and differences in sequences from species to species can affect numbering. One of skill in the art will be able to identify the respective residue in any homologous protein and in the respective encoding nucleic acid by methods well known in the art, e.g., by sequence alignment and determination of homologous residues.

Provided herein are methods of using the base editor or base editor system for editing a nucleobase in a target nucleotide sequence associated with a disease or disorder. In some embodiments, the activity of the base editor (e.g., comprising an adenosine deaminase and a Cas9 domain) results in a correction of the point mutation. In some embodiments, the target DNA sequence comprises a G→A point mutation associated with a disease or disorder, and wherein the deamination of the mutant A base results in a sequence that is not associated with a disease or disorder. In some embodiments, the target DNA sequence comprises a T→C point mutation associated with a disease or disorder, and wherein the deamination of the mutant C base results in a sequence that is not associated with a disease or disorder.

In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino acid encoded by the mutant codon. In some embodiments, the deamination of the mutant A results in the codon encoding the wild-type amino acid. In some embodiments, the deamination of the mutant C results in a change of the amino acid encoded by the mutant codon. In some embodiments, the deamination of the mutant C results in the codon encoding the wild-type amino acid. In some embodiments, the subject has or has been diagnosed with a disease or disorder.

In some embodiments, the adenosine deaminases provided herein are capable of deaminating adenine of a deoxyadenosine residue of DNA. Other aspects of the disclosure provide fusion proteins that comprise an adenosine deaminase (e.g., an adenosine deaminase that deaminates deoxyadenosine in DNA as described herein) and a domain (e.g., a Cas9 or a Cpf 1 protein) capable of binding to a specific nucleotide sequence. For example, the adenosine can be converted to an inosine residue, which typically base pairs with a cytosine residue. Such fusion proteins are useful inter alia for targeted editing of nucleic acid sequences. Such fusion proteins can be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a G to A, or a T to C to mutation can be treated using the nucleobase editors provided herein. The present disclosure provides deaminases, fusion proteins, nucleic acids, vectors, cells, compositions, methods, kits, systems, etc. that utilize the deaminases and nucleobase editors.

Use of Nucleobase Editors to Target Nucleotides in the Mecp2 Gene

The suitability of nucleobase editors that target a nucleotide in the Mecp2 gene is evaluated as described herein. In one embodiment, a single cell of interest is transfected, transduced, or otherwise modified with a nucleic acid molecule or molecules encoding a nucleobase editor described herein together with a small amount of a vector encoding a reporter (e.g., GFP). These cells can be immortalized human cell lines, such as 293T, K562 or U20S. Alternatively, primary human cells may be used. Cells may also be obtained from a subject or individual, such as from tissue biopsy, surgery, blood, plasma, serum, or other biological fluid. Such cells may be relevant to the eventual cell target, Delivery may be performed using a viral vector as further described below. In one embodiment, transfection may be performed using lipid transfection (such as using the lipid delivery agent LIPOFECTAMINE™ or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the target gene to detect alterations in the target sequence. For Sanger sequencing, purified PCR amplicons are cloned into a plasmid backbone, transformed, miniprepped and sequenced with a single primer. Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq high-throughput DNA sequencer).

The fusion proteins that induce the greatest levels of target specific alterations in initial tests can be selected for further evaluation.

In particular embodiments, the nucleobase editors are used to target polynucleotides of interest. In one embodiment, a nucleobase editor of the invention is delivered to cells (e.g., a neuron) in conjunction with a guide RNA that is used to target a nucleic acid sequence, e.g., a Mecp2 polynucleotide harboring RTT-associated mutations, thereby altering the target gene, i.e., Mecp2.

In some embodiments, a base editor is targeted by a guide RNA to introduce one or more edits to the sequence of a gene of interest. In some embodiments, the one or more alterations introduced into the Mecp2 gene are as presented in Table 6 infra.

Generating an Intended Mutation

In some embodiments, the purpose of the methods provided herein is to restore the function of a dysfunctional gene via gene editing. In some embodiments, the function of a dysfunctional gene is restored by introducing an intended mutation. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a polynucleotide programmable nucleotide binding domain (e.g., Cas9) and a nucleobase editing domain (e.g., an adenosine deaminase domain or a cytidine deaminase domain) can be used to correct any single point A to G or C to T mutation. In the first case, deamination of the mutant A to I corrects the mutation, and in the latter case, deamination of the A that is base-paired with the mutant T, followed by a round of replication, corrects the mutation.

In some embodiments, the present disclosure provides base editors that can efficiently generating an intended mutation, such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., cytidine base editor or adenosine base editor) bound to a guide polynucleotide (e.g., gRNA), specifically designed to generate the intended mutation. In some embodiments, the intended mutation is a mutation associated with a disease or disorder. In some embodiments, the intended mutation is an adenine (A) to guanine (G) point mutation associated with a disease or disorder. In some embodiments, the intended mutation is a cytosine (C) to thymine (T) point mutation associated with a disease or disorder. In some embodiments, the intended mutation is an adenine (A) to guanine (G) point mutation within the coding region or non-coding region of a gene. In some embodiments, the intended mutation is a cytosine (C) to thymine (T) point mutation within the coding region or non-coding region of a gene. In some embodiments, the intended mutation is a point mutation that generates a stop codon, for example, a premature stop codon within the coding region of a gene. In some embodiments, the intended mutation is a mutation that eliminates a stop codon.

In some embodiments, any of the base editors provided herein are capable of generating a ratio of intended mutations to unintended mutations (e.g., intended point mutations unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more Details of base editor efficiency are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, said editing of said plurality of nucleobase pairs in one or more genes result in formation of at least one intended mutation. In some embodiments, said formation of said at least one intended mutation results in a precise correction of a disease-causing mutation. It should be appreciated that the characteristics of the multiplex editing of the base editors as described herein can be applied to any of combination of the methods of using the base editor provided herein.

Precise Correction of Pathogenic Mutations

In some embodiments, the intended mutation is a precise correction of a pathogenic mutation or a disease-causing mutation. The pathogenic mutation can be a pathogenic single nucleotide polymorphism (SNP) or be caused by a SNP. For example, the pathogenic mutation can be an amino acid change in a protein encoded by a gene. In another example, the pathogenic mutation can be a pathogenic SNP in a gene. The precise correction can be to revert the pathogenic mutation back to its wild-type state. In some embodiments, the pathogenic mutation is a G→A point mutation associated with a disease or disorder, and wherein the deamination of the mutant A base with an A-to-G base editor (ABE) results in a sequence that is not associated with a disease or disorder. In some embodiments, the pathogenic mutation is a C→T point mutation. The C→T point mutation can be corrected, for example, by targeting an A-to-G base editor (ABE) to the opposite strand and editing the complement A of the pathogenic T nucleobase. In some embodiments, the pathogenic mutation is a T→C point mutation associated with a disease or disorder, and wherein the deamination of the mutant C base with a C-to-T base editor (BE or CBE) results in a sequence that is not associated with a disease or disorder. In some embodiments, the pathogenic mutation is an A→G point mutation. The A→G point mutation can be corrected, for example, by targeting a CBE to the opposite strand and editing the complement C of the pathogenic G nucleobase. A base editor can be targeted to a pathogenic SNP, or to the complement of the pathogenic SNP. The nomenclature of the description of pathogenic or disease-causing mutations and other sequence variations are described in den Dunnen, J. T. and Antonarakis, S. E., "Mutation Nomenclature Extensions and Suggestions to Describe Complex Mutations: A Discussion." Human Mutation 15:712 (2000), the entire contents of which is hereby incorporated by reference.

In a particular embodiment, the disease or disorder is Rett Syndrome (RTT). In some embodiments, the pathogenic mutation is in the Mecp2 gene.

Delivery System

A base editor disclosed herein can be encoded on a nucleic acid that is contained in a viral vector. Exemplary viral vectors include retroviral vectors (e.g. Maloney murine leukemia virus, MML-V), adenoviral vectors (e.g. AD100), lentiviral vectors (HIV and FIV-based vectors), herpesvirus vectors (e.g. HSV-2), and adeno-associated viral vectors.

Adeno-Associated Viral Vectors (AAVs)

Adeno-associated virus ("AAV") vectors can also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

In terms of in vivo delivery, AAV can be advantageous over other viral vectors. In some cases, AAV allows low toxicity, which can be due to the purification method not requiring ultra-centrifugation of cell particles that can activate the immune response. In some cases, AAV allows low probability of causing insertional mutagenesis because it doesn't integrate into the host genome.

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vµl, Vp2, and Vp3, produced in a 1:1:10 ratio from the same open reading frame but from differential splicing (Vµl) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vµl.

AAV has a packaging limit of 4.5 or 4.75 Kb. Accordingly, a disclosed base editor as well as a promoter and transcription terminator can be harbored in a single viral vector. Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some cases, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. A tabulation of certain AAV serotypes as to these cells can be found in Grimm, D. et al, J. Virol. 82: 5887-5911 (2008)).

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

In one embodiment, dual AAV vectors are generated by splitting a large transgene expression cassette in two separate halves (5' and 3' ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5' and 3' genomes (dual AAV overlapping vectors); (2) ITR-mediated tail-to-head concatemerization of 5' and 3' genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol., 66:2731-2739 (1992); Johann et al., J. Virol. 66:1635-1640 (1992); Sommnerfelt et al., Virol., 176:58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some aspects, a base editor of the present disclosure is of sufficient size so as to enable efficient packaging and delivery into a target cell via a retroviral vector. In some cases, a base editor is of a size so as to allow efficient packing and delivery even when expressed together with a guide nucleic acid and/or other components of a targetable nuclease system.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system.

A base editor described herein can therefore be delivered with viral vectors. One or more components of the base editor system can be encoded on one or more viral vectors. For example, a base editor and guide nucleic acid can be encoded on a single viral vector. In other cases, the base editor and guide nucleic acid are encoded on different viral vectors. In either case, the base editor and guide nucleic acid can each be operably linked to a promoter and terminator.

The combination of components encoded on a viral vector can be determined by the cargo size constraints of the chosen viral vector.

Any suitable promoter can be used to drive expression of the base editor and, where appropriate, the guide nucleic acid. For ubiquitous expression, promoters that can be used include CMV, CAG, CBh, PGK, SV40, Ferritin heavy or light chains, etc. For brain or other CNS cell expression, suitable promoters can include: SynapsinI for all neurons, Ca MKIIalpha for excitatory neurons, GAD67 or GAD65 or VGAT for GABAergic neurons, etc. For liver cell expression, suitable promoters include the Albumin promoter. For lung cell expression, suitable promoters can include SP-B. For endothelial cells, suitable promoters can include ICAM. For hematopoietic cells suitable promoters can include IFN-beta or CD45. For Osteoblasts suitable promoters can include OG-2.

A promoter used to drive base editor coding nucleic acid molecule expression can include AAV ITR. This can be advantageous for eliminating the need for an additional promoter element, which can take up space in the vector. The additional space freed up can be used to drive the expression of additional elements, such as a guide nucleic acid or a selectable marker. ITR activity is relatively weak, so it can be used to reduce potential toxicity due to over expression of the chosen nuclease.

In some cases, a base editor of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters such as U6 or H1 Use of Pol II promoter and intronic cassettes to express gRNA Adeno Associated Virus (AAV).

A base editor described herein with or without one or more guide nucleic acids can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media is changed to OPTIMEM™ (serum-free) media and transfection was done 4 hours later. Cells are transfected with 10 μg of lentiviral transfer plasmid (pCasES10) and the following packaging plasmids: 5 μg of pMD2.G (VSV-g pseudotype), and 7.5 μg of psPAX2 (gag/pol/rev/tat). Transfection can be done in 4 mL OPTIMEM™ media with a cationic lipid delivery agent (50 μl LIPOFECTAMINE™ 2000 and 100 ul Plus reagent). After 6 hours, the media is changed to antibiotic-free DMEM with 10% fetal bovine serum. These methods use serum during cell culture, but serum-free methods are preferred.

Lentivirus can be purified as follows. Viral supernatants are harvested after 48 hours. Supernatants are first cleared of debris and filtered through a 0.45 μm low protein binding (PVDF) filter. They are then spun in an ultracentrifuge for 2 hours at 24,000 rpm. Viral pellets are resuspended in 50 μl of DMEM overnight at 4° C. They are then aliquoted and immediately frozen at −80° C.

In another embodiment, minimal non-primate lentiviral vectors based on the equine infectious anemia virus (EIAV) are also contemplated. In another embodiment, RetinoStat®, an equine infectious anemia virus-based lentiviral gene therapy vector that expresses angiostatic proteins endostatin and angiostatin that is contemplated to be delivered via a subretinal injection. In another embodiment, use of self-inactivating lentiviral vectors is contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional Kozak sequence (GCCACC), nuclease sequence, and 3' UTR such as a 3' UTR from beta globin-polyA tail. The cassette can be used for transcription by T7 polymerase. Guide polynucleotides (e.g., gRNA) can also be transcribed using in vitro transcription from a cassette containing a T7 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The disclosure in some embodiments comprehends a method of modifying a cell or organism. The cell can be a prokaryotic cell or a eukaryotic cell. The cell can be a mammalian cell. The mammalian cell many be a non-human primate, bovine, porcine, rodent or mouse cell. The modification introduced to the cell by the base editors, compositions and methods of the present disclosure can be such that the cell and progeny of the cell are altered for improved production of biologic products such as an antibody, starch, alcohol or other desired cellular output. The modification introduced to the cell by the methods of the present disclosure can be such that the cell and progeny of the cell include an alteration that changes the biologic product produced.

The system can comprise one or more different vectors. In an aspect, the base editor is codon optimized for expression the desired cell type, preferentially a eukaryotic cell, preferably a mammalian cell or a human cell.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/(visited Jul. 9, 2002), and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper.

The helper virus can promote replication of the AAV vector and expression of AAV genes from the helper plasmid. The helper plasmid in some cases is not packaged in significant amounts due to a lack of ITR sequences. Contamination with adenovirus can be reduced by, e.g., heat treatment to which adenovirus is more sensitive than AAV.

Non-Viral Delivery of Base Editors

Non-viral delivery approaches for delivery of base editors are also available. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 3 (below).

TABLE 3

Lipids Used for Gene Transfer

| Lipid | Abbreviation | Feature |
|---|---|---|
| l,2-Dioleoyl-sn-glycero-3-phosphatidylcholine | DOPC | Helper |
| l,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexylomithinate | LHON | Cationic |
| 1-(2,3-Dioleoyloxypropyl)-2,4,6-trimethylpyridinium | 20c | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1 -Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 4 lists exemplary polymers for use in gene transfer and/or nanoparticle formulations.

TABLE 4

| Polymers Used for Gene Transfer | |
|---|---|
| Polymer | Abbreviation |
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 5 summarizes delivery methods for a polynucleotide encoding a fusion protein described herein.

TABLE 5

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated | YES | Stable | NO | DNA |
| | Virus (AAV) Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological | Attenuated | YES | Transient | NO | Nucleic Acids |
| Non-Viral | Bacteria | YES | Transient | NO | Nucleic Acids |
| Delivery | Engineered | | | | |
| Vehicles | Bacteriophages | YES | Transient | NO | Nucleic Acids |
| | Mammalian | | | | |
| | Virus-like Particles | YES | Transient | NO | Nucleic Acids |
| | Biological liposomes: Erythrocyte Ghosts and Exosomes | | | | |

In another aspect, the delivery of genome editing system components or nucleic acids encoding such components, for example, a nucleic acid binding protein such as, for example, Cas9 or variants thereof, and a gRNA targeting a genomic nucleic acid sequence of interest, may be accomplished by delivering a ribonucleoprotein (RNP) to cells. The RNP comprises the nucleic acid binding protein, e.g., Cas9, in complex with the targeting gRNA. RNPs may be delivered to cells using known methods, such as electroporation, nucleofection, or cationic lipid-mediated methods, for example, as reported by Zuris, J. A. et al., 2015, *Nat. Biotechnology,* 33(1):73-80. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid based techniques, RNPs can be used to deliver binding protein (e.g., Cas9 variants) and to direct homology directed repair (HDR).

Pharmaceutical Compositions

Other aspects of the present disclosure relate to pharmaceutical compositions comprising any of the base editors, fusion proteins, or the fusion protein-guide polynucleotide complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum lcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g., tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249: 1527-1533; Sefton, 1989, CRC Crit. Ref. Biomed. Eng. 14:201; Buchwald et al., 1980, Surgery 88:507; Saudek et al, 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228: 190; During et al., 1989, Ann. Neurol. 25:351; Howard et ah, 1989, J. Neurosurg. 71: 105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et ah, Gene Ther. 1999, 6: 1438-47). Positively charged lipids such as N-[1-(2,3-dioleoyloxi)propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication number WO2011053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

Methods of Treating RTT

Provided also are methods of treating Rett Syndrome (RTT) and/or the genetic mutations in Mecp2 that cause RTT that comprise administering to a subject (e.g., a mammal, such as a human) a therapeutically effective amount of a pharmaceutical composition that comprises a polynucleotide encoding a base editor system (e.g., base editor and gRNA) described herein. In some embodiments, the base editor is a fusion protein that comprises a polynucleotide programmable DNA binding domain and an adenosine deaminase domain or a cytidine deaminase domain. A cell of the subject is transduced with the base editor and one or more guide polynucleotides that target the base editor to effect an A•T to G•C alteration (if the cell is transduced with an adenosine deaminase domain) or a C•G to U•A alteration (if the cell is transduced with a cytidine deaminase domain) of a nucleic acid sequence containing mutations in the Mecp2 gene.

The methods herein include administering to the subject (including a subject identified as being in need of such treatment, or a subject suspected of being at risk of disease and in need of such treatment) an effective amount of a composition described herein. Identifying a subject in need of such treatment can be in the judgment of a subject or a health care professional and can be subjective (e.g. opinion) or objective (e.g. measurable by a test or diagnostic method).

The therapeutic methods, in general, comprise administration of a therapeutically effective amount of a pharmaceutical composition comprising, for example, a vector encoding a base editor and a gRNA that targets the Mecp2 gene of a subject (e.g., a human patient) in need thereof. Such treatment will be suitably administered to a subject, particularly a human subject, suffering from, having, susceptible to, or at risk for RTT. The compositions herein may be also used in the treatment of any other disorders in which RTT may be implicated.

In one embodiment, the invention provides a method of monitoring treatment progress is provided. The method includes the step of determining a level of diagnostic marker (Marker) (e.g., SNP associated with RTT) or diagnostic measurement (e.g., screen, assay) in a subject suffering from or susceptible to a disorder or symptoms thereof associated with RTT in which the subject has been administered a therapeutic amount of a composition herein sufficient to treat the disease or symptoms thereof. The level of Marker determined in the method can be compared to known levels of Marker in either healthy normal controls or in other afflicted patients to establish the subject's disease status. In preferred embodiments, a second level of Marker in the subject is determined at a time point later than the determination of the first level, and the two levels are compared to monitor the course of disease or the efficacy of the therapy. In certain preferred embodiments, a pre-treatment level of Marker in the subject is determined prior to beginning treatment according to this invention; this pre-treatment level of Marker can then be compared to the level of Marker in the subject after the treatment commences, to determine the efficacy of the treatment.

In some embodiments, cells are obtained from the subject and contacted with a pharmaceutical composition as provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Kits

Various aspects of this disclosure provide kits comprising a base editor system. In one embodiment, the kit comprises a nucleic acid construct comprising a nucleotide sequence encoding a nucleobase editor fusion protein. The fusion protein comprises a deaminase (e.g., cytidine deaminase or adenine deaminase) and a nucleic acid programmable DNA binding protein (napDNAbp). In some embodiments, the kit comprises at least one guide RNA capable of targeting a nucleic acid molecule of interest, e.g., Mecp2 RTT-associated mutations. In some embodiments, the kit comprises a nucleic acid construct comprising a nucleotide sequence encoding at least one guide RNA.

The kit provides, in some embodiments, instructions for using the kit to edit one or more Mecp2 RTT-associated mutations. The instructions will generally include information about the use of the kit for editing nucleic acid molecules. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

In certain embodiments, the kit is useful for the treatment of a subject having Rett Syndrome.

The practice of the embodiments disclosed herein employ, unless otherwise indicated, conventional techniques of immunology, biochemistry, chemistry, molecular biology, microbiology, cell biology, genomics and recombinant DNA, which are within the skill of the art. See, for example, Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G.

R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)).

The following numbered additional embodiments encompassing the methods and compositions of the base editor systems and uses are envisioned herein:

1. A method of treating Rett Syndrome (RTT) in a subject in need thereof, comprising administering to the subject a base editor system comprising
   a guide polynucleotide or a nucleic acid encoding the guide polynucleotide;
   a polynucleotide programmable DNA binding domain or a nucleic acid encoding the polynucleotide programmable DNA binding domain, and
   an adenosine deaminase domain or a nucleic acid encoding the adenosine deaminase domain,
   wherein the guide polynucleotide is capable of targeting the base editor system to effect an A•T to G•C alteration of a single nucleotide polymorphism (SNP) causative of RTT in a MECP2 polynucleotide of a cell in the subject, thereby treating RTT.
2. A method of treating Rett Syndrome (RTT) in a subject in need thereof, comprising
   (a) introducing into a cell a base editor system comprising
   a guide polynucleotides or a nucleic acid encoding the guide polynucleotide;
   a polynucleotide programmable DNA binding domain or a nucleic acid encoding the polynucleotide programmable DNA binding domain, and
   an adenosine deaminase domain or a nucleic acid encoding the adenosine deaminase domain, and
   (b) administering the cell to the subject,
   wherein the guide polynucleotide is capable of targeting the base editor system to effect an A•T to G•C alteration of a single nucleotide polymorphism (SNP) causative of RTT in a MECP2 polynucleotide in the cell, thereby treating the disease.
3. The method of embodiment 2, wherein the cell is a neuron.
4. The method of embodiment 2 or 3, wherein the cell is autologous, allogenic, or xenogenic to the subject.
5. A method of editing a MECP2 polynucleotide, comprising contacting the MECP2 polynucleotide with a base editor system comprising
   a guide polynucleotides;
   a polynucleotide programmable DNA binding domain, and
   an adenosine deaminase domain,
   wherein the guide polynucleotides is capable of targeting the base editor system to effect an A•T to G•C of a single nucleotide polymorphism (SNP) causative of Rett Syndrome (RTT) in the MECP2 polynucleotide.
6. A method of producing a modified cell for treatment of Rett Syndrome (RTT), comprising introducing into a cell a base editor system comprising
   a guide polynucleotides or a nucleic acid encoding the guide polynucleotide;
   a polynucleotide programmable DNA binding domain or a nucleic acid encoding the polynucleotide programmable DNA binding domain, and
   an adenosine deaminase domain or a nucleic acid encoding the adenosine deaminase domain,
   wherein the guide polynucleotide is capable of targeting the base editor system to effect an A•T to G•C alteration of a single nucleotide polymorphism (SNP) causative of RTT in a MECP2 polynucleotide in the cell.
7. The method of embodiment 6, wherein the introduction is in vivo.
8. The method of embodiment 6, wherein the introduction is ex vivo.
9. The method of any one of embodiments 6-8, wherein the cell is a neuron.
10. The method of any one of embodiments 6-9, wherein the cell is obtained from a subject having RTT.
11. The method of any one of the preceding embodiments, wherein MECP2 polynucleotide encodes an MECP2 protein comprising a pathogenic amino acid comprising a tryptophan at position 106, a cysteine at position 133, a stop codon at position 255, a stop codon at position 270, or a cysteine at position 306 resulted from the SNP.
12. The method of embodiment 11, wherein the A•T to G•C alteration substitutes the pathogenic amino acid with a wild type amino acid.
13. A method of treating Rett Syndrome (RTT) in a subject in need thereof, comprising administering to the subject a base editor system comprising
   a guide polynucleotide or a nucleic acid encoding the guide polynucleotide;
   a polynucleotide programmable DNA binding domain or a nucleic acid encoding the polynucleotide programmable DNA binding domain, and
   an adenosine deaminase domain or a nucleic acid encoding the adenosine deaminase domain,
   wherein the guide polynucleotide is capable of targeting the base editor system to effect an A•T to G•C alteration of a single nucleotide polymorphism (SNP) causative of RTT in a MECP2 polynucleotide of a cell in the subject,
   wherein the MECP2 polypeptide encodes a MECP2 protein comprising a pathogenic amino acid comprising a tryptophan at position 106, a cysteine at position 133, a stop codon at position 255, a stop codon at position 270, or a cysteine at position 306 resulted from the SNP, wherein the A•T to G•C alteration substitutes the pathogenic amino acid with a wild type amino acid, thereby treating RTT.
14. A method of treating Rett Syndrome (RTT) in a subject in need thereof, comprising
   (a) contacting a cell with a base editor system comprising
      a guide polynucleotide or a nucleic acid encoding the guide polynucleotide;
      a polynucleotide programmable DNA binding domain or a nucleic acid encoding the polynucleotide programmable DNA binding domain, and
      an adenosine deaminase domain or a nucleic acid encoding the adenosine deaminase domain,
   (b) administering the cell to the subject,
   wherein the guide polynucleotide is capable of targeting the base editor system to effect an A•T to G•C alteration of a single nucleotide polymorphism (SNP) causative of RTT in a MECP2 polynucleotide in the cell,
   wherein the MECP2 polypeptide encodes a MECP2 protein comprising a pathogenic amino acid comprising a tryptophan at position 106, a cysteine at position 133, a stop codon at position 255, a stop codon at position 270, or a cysteine at position 306 resulted from the SNP, wherein the A•T to G•C alteration substitutes the pathogenic amino acid with a wild type amino acid, thereby treating RTT.

15. The method of embodiment 14, wherein the cell is a neuron.

16. The method of embodiment 14 or 15, wherein the cell is autologous, allogenic, or xenogenic to the subject.

17. A method of correcting a single nucleotide polymorphism (SNP) causative of RTT in a MECP2 polynucleotide, comprising contacting the MECP2 polynucleotide with a base editor system comprising
a guide polynucleotide;
a polynucleotide programmable DNA binding domain, and
an adenosine deaminase domain,
wherein the guide polynucleotides is capable of targeting the base editor system to effect an A•T to G•C of the SNP,
wherein the MECP2 polypeptide encodes a MECP2 protein comprising a pathogenic amino acid comprising a tryptophan at position 106, a cysteine at position 133, a stop codon at position 255, a stop codon at position 270, or a cysteine at position 306 resulted from the SNP, wherein the A•T to G•C alteration substitutes the pathogenic amino acid with a wild type amino acid, thereby correcting the SNP.

18. A method of producing a modified cell for treatment of Rett Syndrom (RTT), comprising introducing into a cell a base editor system comprising
a guide polynucleotides or a nucleic acid encoding the guide polynucleotide;
a polynucleotide programmable DNA binding domain or a nucleic acid encoding the polynucleotide programmable DNA binding domain, and
an adenosine deaminase domain or a nucleic acid encoding the adenosine deaminase domain,
wherein the guide polynucleotide is capable of targeting the base editor system to effect an A•T to G•C alteration of a single nucleotide polymorphism (SNP) in a MECP2 polynucleotide in the cell,
wherein the MECP2 polypeptide encodes a MECP2 protein comprising a pathogenic amino acid comprising a tryptophan at position 106, a cysteine at position 133, a stop codon at position 255, a stop codon at position 270, or a cysteine at position 306 resulted from the SNP, wherein the A•T to G•C alteration substitutes the pathogenic amino acid with a wild type amino acid.

19. The method of embodiment 18, wherein the introduction is in vivo.

20. The method of embodiment 18, wherein the introduction is ex vivo.

21. The method of any one of embodiments 18-20, wherein the cell is a neuron.

22. The method of any one of embodiments 18-21, wherein the cell is obtained from a subject having RTT.

23. The method of any one of embodiments 12-22, wherein the wild type amino acid is an arginine.

24. The method of embodiment 23, wherein the A•T to G•C alteration substitutes a stop codon at position 255 of the MECP2 protein with an arginine.

25. The method of embodiment 24, wherein the SNP is at position 763 of the MECP2 polynucleotide.

26. The method of any one of the preceding embodiments, wherein the polynucleotide programmable DNA binding domain is a Cas9 domain.

27. The method of embodiment 26, wherein the Cas9 domain is a nuclease inactive Cas9 domain.

28. The method of embodiment 26, wherein the Cas9 domain is a Cas9 nickase domain.

29. The method of any one of embodiments 26-28, wherein the Cas9 domain comprises a SpCas9 domain 30. The method of embodiment 29, wherein the SpCas9 domain comprises a D10A and/or a H840A amino acid substitution or corresponding amino acid substitutions thereof.

31. The method of embodiment 29 or 30, wherein the SpCas9 domain has specificity for a NGG PAM.

32. The method of any one of embodiments 29-31, wherein the SpCas9 domain has specificity for a NGA PAM, a NGT PAM, or a NGC PAM.

33. The method of any one of embodiments 29-32, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, R1335Q, T1337I, T1337V, T1337F, and T1337M or corresponding amino acid substitutions thereof.

34. The method of any one of embodiments 29-32, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, D1332S, D1332T, D1332V, D1332L, D1332K, D1332R, R1335Q, T13371, T1337V, T1337F, T1337S, T1337N, T1337K, T1337R, T1337H, T1337Q, and T1337M or corresponding amino acid substitutions thereof.

35. The method of any one of embodiments 29-32, wherein the SpCas9 domain comprises amino acid substitutions D1135L, S1136R, G1218S, E1219V, A1322R, R1335Q, T1337, and A1322R, and one or more of L1111, D1135L, S1136R, G1218S, E1219V, D1332A, D1332S, D1332T, D1332V, D1332L, D1332K, D1332R, R1335Q, T13371, T1337V, T1337F, T1337S, T1337N, T1337K, T1337R, T1337H, T1337Q, and T1337M or corresponding amino acid substitutions thereof.

36. The method of any one of embodiments 29-32, wherein the SpCas9 domain comprises amino acid substitutions D1135M, S1136Q, G1218K, E1219F, A1322R, D1332A, R1335E, and T1337R, or corresponding amino acid substitutions thereof.

37. The method of any one of embodiments 29-32, wherein the SpCas9 domain has specificity for a NG PAM, a NNG PAM, a GAA PAM, a GAT PAM, or a CAA PAM.

38. The method of embodiment 36, wherein the Cas9 domain comprises amino acid substitutions E480K, E543K, and E1219V or corresponding amino acid substitutions thereof.

39. The method of any one of embodiments 26-28, wherein the Cas9 domain comprises a SaCas9 domain.

40. The method of embodiment 39, wherein the SaCas9 domain has specificity for a NNNRRT PAM.

41. The method of embodiment 40, wherein the SaCas9 domain has specificity for a NNGRRT PAM.

42. The method of any one of embodiments 39-41, wherein the SaCas9 domain comprises an amino acid substitution N579A or a corresponding amino acid substitution thereof.

43. The method of any one of embodiments 39-42, wherein the SaCas9 domain comprises amino acid substitutions E782K, N968K, and R1015H, or corresponding amino acid substitutions thereof.

44. The method of any one of embodiments 26-28, wherein the Cas9 domain comprises a St1Cas9 domain.
45. The method of embodiment 44, wherein the St1Cas9 domain has specificity for a NNACCA PAM.
46. The method of any one of the preceding embodiments, wherein the adenosine deaminase domain is a modified adenosine deaminase domain that does not occur in nature.
47. The method of embodiment 46, wherein the adenosine deaminase domain comprises a TadA domain.
48. The method of embodiment 47, wherein the TadA domain comprises the amino acid sequence of TadA 7.10.
49. The method of any one of the preceding embodiments, wherein the base editor system further comprises a zinc finger domain.
50. The method of embodiment 97, wherein the zinc finger domain comprises recognition helix sequences RNEHLEV (SEQ ID NO: 131), QSTTLKR (SEQ ID NO: 132), and RTEHLAR (SEQ ID NO: 133) or recognition helix sequences RGEHLRQ (SEQ ID NO: 134), QSGTLKR (SEQ ID NO: 135), and RNDKLVP (SEQ ID NO: 136).
51. The method of embodiment 49 or 50, wherein the zinc finger domain is zflra or zflrb.
52. The method of any one of the preceding embodiments, wherein the base editor system further comprises a nuclear localization signal (NLS).
53. The method of any one of the preceding embodiments, wherein the base editor system further comprises one or more linkers.
54. The method of embodiment 53, wherein two or more of the polynucleotide programmable DNA binding domain, the adenosine deaminase domain, the zinc finger domain, and the NLS are connected via a linker.
55. The method of embodiment 54, wherein the linker is a peptide linker, thereby forming a base editing fusion protein.
56. The method of embodiment 55, wherein the peptide linker comprises an amino acid sequence selected from the group consisting of SGGSSGSETPGTSESAT-PESSGGS (SEQ ID NO: 23), SGGSSGGSSG-SETPGTSESATPESSGGSSGGS (SEQ ID NO: 24), GGSGGSPGSPAGSPTSTEEGTSESATPESGPGT-STEPSEGSAPGSPAGSPTSTEEGT STEPSEGSAPGTSTEPSEGSAPGTSESAT-PESGPGSEPATSGGSGGS (SEQ ID NO: 25), SGGSSGGSSGSETPGTSESATPES (SEQ ID NO: 26), SGGSSGGSSGSETPGTSESAT-PESSGGSSGGSSGGSSGGS (SEQ ID NO: 27), SGGSSGGSSGSETPGTSESAT-PESSGGSSGGSSGGSSGGSSGSETPGTSESAT-PESS GGSSGGS (SEQ ID NO: 28), PGSPAGSPT-STEEGTSESATPESGPGTSTEPSEGSAPGSPAGSPT-STEEGTSTEPSEG SAP GTSTEPSEGSAPGTSESATPESGPGSEPATS (SEQ ID NO: 29), (SGGS)n (SEQ ID NO: 8), (GGGS)n (SEQ ID NO: 127), (GGGGS)n (SEQ ID NO: 128), (G)n, (EAAAK)n (SEQ ID NO: 129), (GGS)n, SGSETPGTSESATPES (SEQ ID NO: 7), and (XP)n.
57. The method of embodiment 55 or 56, wherein the base editing fusion protein comprises the amino acid sequence selected from the group consisting of

```
                                                  (SEQ ID NO: 137)
MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMIHS

RIGRVVFGARDAKTGAAGSLMDVLHHPGMNHRVEITEGILADECAALLSDFFR

MRRQEIKAQKKAQSSTDSGGSSGGSSGSETPGTSESATPESSGGSSGGSSEVEFSH

EYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSS

TDSGGSSGGSSGSETPGTSESATPESDLVLGLAIGIGSVGVGILNKVTGEIIHKNSR

IFPAAQAENNLVRRTNRQGRRLARRKKHRRVRLNRLFEESGLITDFTKISINLNPY

QLRVKGLTDELSNEELFIALKNMVKHRGISYLDDASDDGNSSVGDYAQIVKENS

KQLETKTPGQIQLERYQTYGQLRGDFTVEKDGKKHRLINVFPTSAYRSEALRILQ

TQQEFNPQITDEFINRYLEILTGKRKYYHGPGNEKSRTDYGRYRTSGETLDNIFGI

LIGKCTFYPDEFRAAKASYTAQEFNLLNDLNNLTVPTETKKLSKEQKNQIINYVK

NEKAMGPAKLFKYIAKLLSCDVADIKGYRIDKSGKAEIHTFEAYRKMKTLETLDI

EQMDRETLDKLAYVLTLNTEREGIQEALEHEFADGSFSQKQVDELVQFRKANSS

IFGKGWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQKIQK

ANKDEKDAAMLKAANQYNGKAELPHSVFHGHKQLATKIRLWHQQGERCLYTG

KTISIHDLINNSNQFEVDHILPLSITFDDSLANKVLVYATANQEKGQRTPYQALDS

MDDAWSFRELKAFVRESKTLSNKKKEYLLTEEDISKFDVRKKFIERNLVDTLYA
```

-continued

SRVVLNALQEHFRAHKIDTKVSVVRGQFTSQLRRHWGIEKTRDTYHHHAVDALI
IAASSQLNLWKKQKNTLVSYSEDQLLDIETGELISDDEYKESVFKAPYQHFVDTL
KSKEFEDSILFSYQVDSKFNRKISDATIYATRQAKVGKDKADETYVLGKIKDIYT
QDGYDAFMKIYKKDKSKFLMYRHDPQTFEKVIEPILENYPNKQINDKGKEVPCN
PFLKYKEEHGYIRKYSKKGNGPEIKSLKYYDSKLGNHIDITPKDSNNKVVLQSVS
PWRADVYFNKTTGKYEILGLKYADLQFDKGTGTYKISQEKYNDIKKKEGVDSD
SEFKFTLYKNDLLLVKDTETKEQQLFRFLSRTMPKQKHYVELKPYDKQKFEGGE
ALIKVLGNVANSGQCKKGLGKSNISIYKVRTDVLGNQHIIKNEGDKPKLDFPKK
KRKVEGADKRTADGSEFESPKKKRKV, (SEQ ID NO: 138)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMIRRQEIKA
QKKAQSSTDSGGSSGGSSGSETPGTSESATPESSGGSSGGSSEVEFSHEYWMRHA
LTLAKRARDEREVPVGAVLVLNNRVIGEGWNRAIGLHDPTAHAEIMALRQGGL
VMQNYRLIDATLYVTFEPCVMCAGAMIHSRIGRVVFGVRNAKTGAAGSLMDVL
HYPGMNHRVEITEGILADECAALLCYFFRMPRQVFNAQKKAQSSTDSGGSSGGS
SGSETPGTSESATPESSGGSSGGSKRNYILGLAIGITSVGYGIIDYETRDVIDAGVR
LEKEANVENNEGRRSKRGARRLKRRRRHRIQRVKKLLFDYNLLTDHSELSGINP
YEARVKGLSQKLSEEEFSAALLHLAKRRGVHNVNEVEEDTGNELSTKEQISRNS
KALEEKYVAELQLERLKKDGEVRGSINRFKTSDYVKEAKQLLKVQKAYHQLDQ
SFIDTYIDLLETRRTYYEGPGEGSPFGWKDIKEWYEMLMGHCTYFPEELRSVKY
AYNADLYNALNDLNNLVITRDENEKLEYYEKFQIIENVFKQKKKPTLKQIAKEIL
VNEEDIKGYRVTSTGKPEFTNLKVYHDIKDITARKEIIENAELLDQIAKILTIYQSS
EDIQEELTNLNSELTQEEIEQISNLKGYTGTHNLSLKAINLILDELWHTNDNQIAIF
NRLKLVPKKVDLSQQKEIPTTLVDDFILSPVVKRSFIQSIKVINAIIKKYGLPNDIII
ELAREKNSKDAQKMINEMQKRNRQTNERIEEIIRTTGKENAKYLIEKIKLHDMQE
GKCLYSLEAIPLEDLLNNPFNYEVDHIIPRSVSFDNSFNNKVLVKQEENSKKGNR
TPFQYLSSSDSKISYETFKKHILNLAKGKGRISKTKKEYLLEERDINRFSVQKDFIN
RNLVDTRYATRGLMNLLRSYFRVNNLDVKVKSINGGFTSFLRRKWKFKKERNK
GYKHHAEDALIIANADFIFKEWKKLDKAKKVMENQMFEEKQAESMPEIETEQE
YKEIFITPHQIKHIKDFKDYKYSHRVDKKPNRKLINDTLYSTRKDDKGNTLIVNN
LNGLYDKDNDKLKKLINKSPEKLLMYHHDPQTYQKLKLIMEQYGDEKNPLYKY
YEETGNYLTKYSKKDNGPVIKKIKYYGNKLNAHLDITDDYPNSRNKVVKLSLKP
YRFDVYLDNGVYKFVTVKNLDVIKKENYYEVNSKCYEEAKKLKKISNQAEFIAS
FYKNDLIKINGELYRVIGVNNDLLNRIEVNMIDITYREYLENNINDKRPPHIIKTIA
SKTQSIKKYSTDILGNLYEVKSKKHPQIIKKGEGADKRTADGSEFESPKKKRKV, (SEQ ID NO: 139)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFGARDA
KTGAAGSLMDVLHHPGMNHRVEITEGILADECAALLSDFFRMRRQEIKAQKKAQSSTD

-continued

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVFKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

NPFNYEVDHIIPRSVSFDNSFNNKVLVKQEENSKKGNRTPFQYLSSSDSKISYETFKKHIL

NLAKGKGRISKTKKEYLLEERDINRFSVQKDFINRNLVDTRYATRGLMNLLRSYFRVNN

LDVKVKSINGGFTSFLRRKWKFKKERNKGYKHHAEDALIIANADFIFKEWKKLDKAKK

VMENQMFEEKQAESMPEIETEQEYKEIFITPHQIKHIKDFKDYKYSHRVDKKPNRKLIND

TLYSTRKDDKGNTLIVNNLNGLYDKDNDKLKKLINKSPEKLLMYHHDPQTYQKLKLIM

EQYGDEKNPLYKYYEETGNYLTKYSKKDNGPVIKKIKYYGNKLNAHLDITDDYPNSRN

KVVKLSLKPYRFDVYLDNGVYKFVTVKNLDVIKKENYYEVNSKCYEEAKKLKKISNQ

AEFIASFYKNDLIKINGELYRVIGVNNDLLNRIEVNMIDITYREYLENIVINDKRPPHIIKTI

ASKTQSIKKYSTDILGNLYEVKSKKHPQIIKKGEGADKRTADGSEFESPKKKRKVSSGNS

NANSRGPSFSSGLVPLSLRGSHSRPGERPFQCRICMRNFSRNEHLEVHTRTHTGEKPFQC

RICMRNFSQSTTLKRHLRTHTGEKPFQCRTCMRNFSRTEHLARHLKTHLRGSSAQ,
or (SEQ ID NO: 140)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFGARDA

KTGAAGSLMDVLHHPGMNHRVEITEGILADECAALLSDFFRMRRQEIKAQKKAQSSTD

SGGSSGGSSGSETPGTSESATPESSGGSSGGSSEVEFSHEYWMRHALTLAKRARDEREVP

VGAVLVLNNRVIGEGWNRAIGLHDPTAHAEIMALRQGGLVMQNYRLIDATLYVTFEPC

VMCAGAMIHSRIGRVVFGVRNAKTGAAGSLMDVLHYPGMNHRVEITEGILADECAAL

LCYFFRMPRQVFNAQKKAQSSTDSGGSSGGSSGSETPGTSESATPESSGGSSGGSKRNYI

LGLAIGITSVGYGIIDYETRDVIDAGVRLFKEANVENNEGRRSKRGARRLKRRRRHRIQR

VKKLLFDYNLLTDHSELSGINPYEARVKGLSQKLSEEEFSAALLHLAKRRGVHNVNEVE

EDTGNELSTKEQISRNSKALEEKYVAELQLERLKKDGEVRGSINRFKTSDYVKEAKQLL

KVQKAYHQLDQSFIDTYIDLLETRRTYYEGPGEGSPFGWKDIKEWYEMLMGHCTYFPE

ELRSVKYAYNADLYNALNDLNNLVITRDENEKLEYYEKFQIIENVEKQKKKPTLKQIAK

EILVNEEDIKGYRVTSTGKPEFTNLKVYHDIKDITARKEIIENAELLDQIAKILTIYQSSEDI

QEELTNLNSELTQEEIEQISNLKGYTGTHNLSLKAINLILDELWHTNDNQIAIFNRLKLVP

KKVDLSQQKEIPTTLVDDFILSPVVKRSFIQSIKVINAIIKKYGLPNDIIIELAREKNSKDAQ

KMINEMQKRNRQTNERIEEIIRTTGKENAKYLIEKIKLHDMQEGKCLYSLEAIPLEDLLN

-continued

NPFNYEVDHIIPRSVSFDNSFNNKVLVKQEENSKKGNRTPFQYLSSSDSKISYETFKKHIL
NLAKGKGRISKTKKEYLLEERDINRFSVQKDFINRNLVDTRYATRGLMNLLRSYFRVNN
LDVKVKSINGGFTSFLRRKWKFKKERNKGYKHHAEDALIIANADFIFKEWKKLDKAKK
VMENQMFEEKQAESMPEIETEQEYKEIFITPHQIKHIKDFKDYKYSHRVDKKPNRKLIND
TLYSTRKDDKGNTLIVNNLNGLYDKDNDKLKKLINKSPEKLLMYHHDPQTYQKLKLIM
EQYGDEKNPLYKYYEETGNYLTKYSKKDNGPVIKKIKYYGNKLNAHLDITDDYPNSRN
KVVKLSLKPYREDVYLDNGVYKEVTVKNLDVIKKENYYEVNSKCYEEAKKLKKISNQ
AEFIASFYKNDLIKINGELYRVIGVNNDLLNRIEVNMIDITYREYLENMNDKRPPHIIKTI
ASKTQSIKKYSTDILGNLYEVKSKKHPQIIKKGEGADKRTADGSEFESPKKKRKVSSGNS
NANSRGPSFSSGLVPLSLRGSHSRPGERPFQCRICMRNFSRGEHLRQHTRTHTGEKPFQC
RICMRNFSQSGTLKRHLRTHTGEKPFQCRICMRNFSRNDKLVPHLKTHLRGSSAQ.

58. The method of any one of the preceding embodiments, wherein the guide polynucleotide comprises two individual polynucleotides, wherein the two individual polynucleotides are two DNAs, two RNAs or a DNA and an RNA.
59. The method of any one of embodiments 1-58, wherein the guide polynucleotides comprise a crRNA and a tracrRNA, wherein the crRNA comprises a nucleic acid sequence complementary to a target sequence in the MECP2 polynucleotide.
60. The method of embodiment 59, wherein the target sequence comprises sequence selected from the group consisting of CCATGTCCAGCCTTCAGGCA (SEQ ID NO: 141), TCCATGTCCAGCCTTCAGGC (SEQ ID NO: 142), TTCCATGTCCAGCCTTCAGG (SEQ ID NO: 143), GCTTCCATGTCCAGCCTTCA (SEQ ID NO: 144), CTTCCATGTCCAGCCTTCAGG (SEQ ID NO: 145), AGCTTCCATGTCCAGCCTTCAGG (SEQ ID NO: 146), AGCTTCCATGTCCAGCCTTC (SEQ ID NO: 147), CTTAAGCTTCCATGTCCAGC (SEQ ID NO: 148), AGCAAAAGGCTTTTCCCTGG (SEQ ID NO: 149), GAGCAAAAGGCTTTTCCCTG (SEQ ID NO: 150), AGAGCAAAAGGCTTTTCCCT (SEQ ID NO: 151), TAGAGCAAAAGGCTTTTCCC (SEQ ID NO: 152), TAGAGCAAAAGGCTTTTCCCT (SEQ ID NO: 153), TTTAGAGCAAAAGGCTTTTCCCT (SEQ ID NO: 154), CCATGAAGTCAAAATCATTA (SEQ ID NO: 155), ACCATGAAGTCAAAATCATT (SEQ ID NO: 156), TACCATGAAGTCAAAATCAT (SEQ ID NO: 157), TTACCATGAAGTCAAAATCAT (SEQ ID NO: 158), AGTTACCATGAAGTCAAAATCAT (SEQ ID NO: 159), CTTTTCACTTCCTGCCGGGG (SEQ ID NO: 160), TCAGCCCCGTTTCTTGGGAA (SEQ ID NO: 161), GCTTTCAGCCCCGTTTCTTG (SEQ ID NO: 162), CGGCTTTCAGCCCCGTTTCTT (SEQ ID NO: 163), CCCGGCTTTCAGCCCCGTTTCTT (SEQ ID NO: 164), GCACTTCTTGATGGGGAGTA (SEQ ID NO: 165), TCTTGCACTTCTTGATGGGG (SEQ ID NO: 166), CTTGCACTTCTTGATGGGGAG (SEQ ID NO: 167), and GTCTTGCACTTCTTGATGGGGAG (SEQ ID NO: 168).
61. The method of embodiment 58 or 59, wherein the base editor system comprises a single guide RNA (sgRNA).
62. The method of embodiment 60, wherein the sgRNA comprises CUUUUCACUUCCUGCCGGGG (SEQ ID NO: 169).
63. A modified cell comprising a base editor system comprising
   a guide polynucleotide or a nucleic acid encoding the guide polynucleotide;
   a polynucleotide programmable DNA binding domain or a nucleic acid encoding the polynucleotide programmable DNA binding domain, and
   an adenosine deaminase domain or a nucleic acid encoding the adenosine deaminase domain,
   wherein the guide polynucleotide is capable of targeting the base editor system to effect an A•T to G•C alteration of a single nucleotide polymorphism (SNP) causative of Rett Syndrome (RTT) in a MECP2 polynucleotide in the cell.
64. A modified cell comprising a base editor system comprising
   a guide polynucleotide or a nucleic acid encoding the guide polynucleotide;
   a polynucleotide programmable DNA binding domain or a nucleic acid encoding the polynucleotide programmable DNA binding domain, and
   an adenosine deaminase domain or a nucleic acid encoding the adenosine deaminase domain, wherein the guide polynucleotide is capable of targeting the base editor system to effect an A•T to G•C alteration of a single nucleotide polymorphism (SNP) causative of Rett Syndrome (RTT) in a MECP2 polynucleotide in the cell, wherein the MECP2 polypeptide encodes a MECP2 protein comprising a pathogenic amino acid comprising a tryptophan at position 106, a cysteine at position 133, a stop codon at position 255, a stop codon at position 270, or a cysteine at position 306 resulted from the SNP, wherein the A•T to G•C alteration substitutes the pathogenic amino acid with a wild type amino acid.
65. The modified cell of embodiment 63, wherein MECP2 polynucleotide encodes an MECP2 protein comprising a pathogenic amino acid comprising a tryptophan at position 106, a cysteine at position 133, a stop codon at position 255, a stop codon at position 270, or a cysteine at position 306 resulted from the SNP.
66. The modified cell of embodiment 65, wherein the A•T to G•C alteration substitutes the pathogenic amino acid with a wild type amino acid.
67. The modified cell of any one of embodiments 63-66, wherein the cell is a neuron.

68. The modified cell of any one of embodiments 63-67, wherein the cell is obtained from a subject having RTT.
69. The modified cell of any one of embodiments 66-68, wherein the wild type amino acid is an arginine.
70. The modified cell of embodiment 69, wherein the the A•T to G•C alteration substitutes a stop codon at position 255 of the MECP2 protein with an arginine
71. The modified cell of embodiment 70, wherein the SNP is at position 763 of the MECP2 polynucleotide.
72. The modified cell of any one of embodiments 63-71, wherein the polynucleotide programmable DNA binding domain is a Cas9 domain.
73. The modified cell of embodiment 72, wherein the Cas9 domain is a nuclease inactive Cas9 domain.
74. The modified cell of embodiment 72, wherein the Cas9 domain is a Cas9 nickase domain.
75. The modified cell of any one of embodiments 72-74, wherein the Cas9 domain comprises a SpCas9 domain.
76. The modified cell of embodiment 75, wherein the SpCas9 domain comprises a D10A and/or a H840A amino acid substitution or corresponding amino acid substitutions thereof.
77. The modified cell of embodiment 75 or 76, wherein the SpCas9 domain has specificity for a NGG PAM.
78. The modified cell of any one of embodiments 75-77, wherein the SpCas9 domain has specificity for a NGA PAM, a NGT PAM, or a NGC PAM.
79. The modified cell of any one of embodiments 75-78, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, R1335Q, T1337I, T1337V, T1337F, and T1337M or corresponding amino acid substitutions thereof.
80. The modified cell of any one of embodiments 75-78, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, D1332S, D1332T, D1332V, D1332L, D1332K, D1332R, R1335Q, T13371, T1337V, T1337F, T1337S, T1337N, T1337K, T1337R, T1337H, T1337Q, and T1337M or corresponding amino acid substitutions thereof.
81. The modified cell of any one of embodiments 75-78, wherein the SpCas9 domain comprises amino acid substitutions D1135L, S1136R, G1218S, E1219V, A1322R, R1335Q, T1337, and A1322R, and one or more of L1111, D1 135L, S1136R, G1218S, E1219V, D1332A, D1332S, D1332T, D1332V, D1332L, D1332K, D1332R, R1335Q, T13371, T1337V, T1337F, T1337S, T1337N, T1337K, T1337R, T1337H, T1337Q, and T1337M or corresponding amino acid substitutions thereof.
82. The modified cell of any one of embodiments 75-78, wherein the SpCas9 domain comprises amino acid substitutions D1135M, S1136Q, G1218K, E1219F, A1322R, D1332A, R1335E, and T1337R, or corresponding amino acid substitutions thereof.
83. The modified cell of any one of embodiments 75 or 76, wherein the SpCas9 domain has specificity for a NG PAM, a NNG PAM, a GAA PAM, a GAT PAM, or a CAA PAM.
84. The modified cell of embodiment 83, wherein the SpCas9 domain comprises amino acid substitutions E480K, E543K, and E1219V or corresponding amino acid substitutions thereof.
85. The modified cell of any one of embodiments 72-74, wherein the Cas9 domain comprises a SaCas9 domain.
86. The modified cell of embodiment 85, wherein the SaCas9 domain has specificity for a NNNRRT PAM.
87. The modified cell of embodiment 86, wherein the SaCas9 domain has specificity for a NNGRRT PAM.
88. The modified cell of any one of embodiments 85-87, wherein the SaCas9 domain comprises an amino acid substitution N579A or a corresponding amino acid substitution thereof.
89. The modified cell of any one of embodiments 85-88, wherein the SaCas9 domain comprises amino acid substitutions E782K, N968K, and R1015H, or corresponding amino acid substitutions thereof.
90. The modified cell of any one of embodiments 72-74, wherein the Cas9 domain comprises a St1Cas9 domain.
91. The modified cell of embodiment 90, wherein the St1Cas9 domain has specificity for a NNACCA PAM.
92. The modified cell of any one of embodiments 63-91, wherein the adenosine deaminase domain is a modified adenosine deaminase domain that does not occur in nature.
93. The modified cell of embodiment 92, wherein the adenosine deaminase domain comprises a TadA domain.
94. The modified cell of embodiment 93, wherein the TadA domain comprises the amino acid sequence of TadA 7.10.
95. The modified cell of embodiments 63-94, wherein the base editor system further comprises a zinc finger domain.
96. The modified cell of embodiment 95, wherein the zinc finger domain comprises recognition helix sequences RNEHLEV (SEQ ID NO: 131), QSTTLKR (SEQ ID NO: 132), and RTEHLAR (SEQ ID NO: 133) or recognition helix sequences RGEHLRQ (SEQ ID NO: 134), QSGTLKR (SEQ ID NO: 135), and RNDKLVP (SEQ ID NO: 136).
97. The modified cell of embodiment 95 or 96, wherein the zinc finger domain is zflra or zflrb.
98. The modified cell of any one of embodiments 63-97, wherein the base editor system further comprises a nuclear localization signal (NLS).
99. The modified cell of any one embodiments 63-98, wherein the base editor system further comprises one or more linkers.
100. The modified cell of embodiment 99, wherein two or more of the polynucleotide programmable DNA binding domain, the adenosine deaminase domain, the zinc finger domain, and the NLS are connected via a linker.
101. The modified cell of embodiment 54, wherein the linker is a peptide linker, thereby forming a base editing fusion protein.
102. The modified cell of embodiment 100, wherein the peptide linker comprises an amino acid sequence selected from the group consisting of SGGSSG-SETPGTSESATPESSGGS

```
SGGSSGSETPGTSESATPESSGGS (SEQ ID NO: 23),

SGGSSGGSSGSETPGTSESATPESSGGSSGGS
(SEQ ID NO: 24),

GGSGGSPGSPAGSPTSTEEGTSESATPESGPGTSTEPSEG

SAPGSPAGSPTSTEEGTSTEPSEGSAPGTSTEPSEGSAPG
```

-continued

TSESATPESGPGSEPATSGGSGGS (SEQ ID NO: 25),

SGGSSGGSSGSETPGTSESATPES (SEQ ID NO: 26),

SGGSSGGSSGSETPGTSESATPESSGGSSGGSSGGSSGGS (SEQ ID NO: 27),

SGGSSGGSSGSETPGTSESATPESSGGSSGGSSGGSSGGS

SGSETPGTSESATPESSGGSSGGS (SEQ ID NO: 28),

PGSPAGSPTSTEEGTSESATPESGPGTSTEPSEGSAPGSP

AGSPTSTEEGTSTEPSEGSAP GTSTEPSEGSAPGTSESATPES

-continued

GPGSEPATS (SEQ ID NO: 29), (SGGS)n (SEQ ID NO: 8), (GGGS)n (SEQ ID NO: 127), (GGGGS)n (SEQ ID NO: 128), (G)n, (EAAAK)n (SEQ ID NO: 129), (GGS)n, SGSETPGTSESATPES (SEQ ID NO: 7), and (XP)n.

103. The modified cell of embodiment 101 or 102, wherein the base editing fusion protein comprises the amino acid sequence selected from the group consisting (SEQ ID NO: 137)

MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMIHS

RIGRVVFGARDAKTGAAGSLMDVLHHPGMNHRVEITEGILADECAALLSDFFR

MRRQEIKAQKKAQSSTDSGGSSGGSSGSETPGTSESATPESSGGSSGGSSEVEFSH

EYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSS

TDSGGSSGGSSGSETPGTSESATPESDLVLGLAIGIGSVGVGILNKVTGEIIHKNSR

IFPAAQAENNLVRRTNRQGRRLARRKKHRRVRLNRLFEESGLITDFTKISINLNPY

QLRVKGLTDELSNEELFIALKNMVKHRGISYLDDASDDGNSSVGDYAQIVKENS

KQLETKTPGQIQLERYQTYGQLRGDFTVEKDGKKHRLINVFPTSAYRSEALRILQ

TQQEFNPQITDEFINRYLEILTGKRKYYHGPGNEKSRTDYGRYRTSGETLDNIFGI

LIGKCTFYPDEFRAAKASYTAQEFNLLNDLNNLTVPTETKKLSKEQKNQIINYVK

NEKAMGPAKLFKYIAKLLSCDVADIKGYRIDKSGKAEIHTFEAYRKMKTLETLDI

EQMDRETLDKLAYVLTLNTEREGIQEALEHEFADGSFSQKQVDELVQFRKANSS

IFGKGWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQKIQK

ANKDEKDAAMLKAANQYNGKAELPHSVFHGHKQLATKIRLWHQQGERCLYTG

KTISIHDLINNSNQFEVDHILPLSITFDDSLANKVLVYATANQEKGQRTPYQALDS

MDDAWSFRELKAFVRESKTLSNKKKEYLLTEEDISKFDVRKKFIERNLVDTLYA

SRVVLNALQEHFRAHKIDTKVSVVRGQFTSQLRRHWGIEKTRDTYHHHAVDALI

IAASSQLNLWKKQKNTLVSYSEDQLLDIETGELISDDEYKESVFKAPYQHFVDTL

KSKEFEDSILFSYQVDSKFNRKISDATIYATRQAKVGKDKADETYVLGKIKDIYT

QDGYDAFMKIYKKDKSKFLMYRHDPQTFEKVIEPILENYPNKQINDKGKEVPCN

PFLKYKEEHGYIRKYSKKGNGPEIKSLKYYDSKLGNHIDITPKDSNNKVVLQSVS

PWRADVYFNKTTGKYEILGLKYADLQFDKGTGTYKISQEKYNDIKKKEGVDSD

SEFKFTLYKNDLLLVKDTETKEQQLFRFLSRTMPKQKHYVELKPYDKQKFEGGE

ALIKVLGNVANSGQCKKGLGKSNISIYKVRTDVLGNQHIIKNEGDKPKLDFPKK

KRKVEGADKRTADGSEFESPKKKRKV,

-continued (SEQ ID NO: 138)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMIRRQEIKA
QKKAQSSTDSGGSSGGSSGSETPGTSESATPESSGGSSGGSSEVEFSHEYWMRHA
LTLAKRARDEREVPVGAVLVLNNRVIGEGWNRAIGLHDPTAHAEIMALRQGGL
VMQNYRLIDATLYVTFEPCVMCAGAMIHSRIGRVVFGVRNAKTGAAGSLMDVL
HYPGMNHRVEITEGILADECAALLCYFFRMPRQVFNAQKKAQSSTDSGGSSGGS
SGSETPGTSESATPESSGGSSGGSKRNYILGLAIGITSVGYGIIDYETRDVIDAGVR
LEKEANVENNEGRRSKRGARRLKRRRRHRIQRVKKLLFDYNLLTDHSELSGINP
YEARVKGLSQKLSEEEFSAALLHLAKRRGVHNVNEVEEDTGNELSTKEQISRNS
KALEEKYVAELQLERLKKDGEVRGSINRFKTSDYVKEAKQLLKVQKAYHQLDQ
SFIDTYIDLLETRRTYYEGPGEGSPFGWKDIKEWYEMLMGHCTYFPEELRSVKY
AYNADLYNALNDLNNLVITRDENEKLEYYEKFQIIENVFKQKKKPTLKQIAKEIL
VNEEDIKGYRVTSTGKPEFTNLKVYHDIKDITARKEIIENAELLDQIAKILTIYQSS
EDIQEELTNLNSELTQEEIEQISNLKGYTGTHNLSLKAINLILDELWHTNDNQIAIF
NRLKLVPKKVDLSQQKEIPTTLVDDFILSPVVKRSFIQSIKVINAIIKKYGLPNDIII
ELAREKNSKDAQKMINEMQKRNRQTNERIEEIIRTTGKENAKYLIEKIKLHDMQE
GKCLYSLEAIPLEDLLNNPFNYEVDHIIPRSVSFDNSFNNKVLVKQEENSKKGNR
TPFQYLSSSDSKISYETFKKHILNLAKGKGRISKTKKEYLLEERDINRFSVQKDFIN
RNLVDTRYATRGLMNLLRSYFRVNNLDVKVKSINGGFTSFLRRKWKFKKERNK
GYKHHAEDALIIANADFIFKEWKKLDKAKKVMENQMFEEKQAESMPEIETEQE
YKEIFITPHQIKHIKDFKDYKYSHRVDKKPNRKLINDTLYSTRKDDKGNTLIVNN
LNGLYDKDNDKLKKLINKSPEKLLMYHHDPQTYQKLKLIMEQYGDEKNPLYKY
YEETGNYLTKYSKKDNGPVIKKIKYYGNKLNAHLDITDDYPNSRNKVVKLSLKP
YREDVYLDNGVYKEVTVKNLDVIKKENYYEVNSKCYEEAKKLKKISNQAEFIAS
FYKNDLIKINGELYRVIGVNNDLLNRIEVNMIDITYREYLENMNDKRPPHIIKTIA
SKTQSIKKYSTDILGNLYEVKSKKHPQIIKKGEGADKRTADGSEFESPKKKRKV, (SEQ ID NO: 139)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMIRRQEIKA
QKKAQSSTDSGGSSGGSSGSETPGTSESATPESSGGSSGGSSEVEFSHEYWMRHA
LTLAKRARDEREVPVGAVLVLNNRVIGEGWNRAIGLHDPTAHAEIMALRQGGL
VMQNYRLIDATLYVTFEPCVMCAGAMIHSRIGRVVFGVRNAKTGAAGSLMDVL
HYPGMNHRVEITEGILADECAALLCYFFRMPRQVFNAQKKAQSSTDSGGSSGGS
SGSETPGTSESATPESSGGSSGGSKRNYILGLAIGITSVGYGIIDYETRDVIDAGVR
LEKEANVENNEGRRSKRGARRLKRRRRHRIQRVKKLLFDYNLLTDHSELSGINP
YEARVKGLSQKLSEEEFSAALLHLAKRRGVHNVNEVEEDTGNELSTKEQISRNS
KALEEKYVAELQLERLKKDGEVRGSINRFKTSDYVKEAKQLLKVQKAYHQLDQ
SFIDTYIDLLETRRTYYEGPGEGSPFGWKDIKEWYEMLMGHCTYFPEELRSVKY -continued

AYNADLYNALNDLNNLVITRDENEKLEYYEKFQIIENVFKQKKKPTLKQIAKEIL

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK

GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

LNGLYDKDNDKLKKLINKSPEKLLMYHHDPQTYQKLKLIMEQYGDEKNPLYKY

YEETGNYLTKYSKKDNGPVIKKIKYYGNKLNAHLDITDDYPNSRNKVVKLSLKP

YREDVYLDNGVYKEVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKVS

SGNSNANSRGPSFSSGLVPLSLRGSHSRPGERPFQCRTCMRNFSRNEHLEVHTRT

HTGEKPFQCRTCMRNFSQSTTLKRHLRTHTGEKPFQCRTCMRNFSRTEHLARHLK

THLRGSSAQ, or (SEQ ID NO: 140)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMIRRQEIKA

QKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGL

VMQNYRLIDATLYVTFEPCVMCAGAMIHSRIGRVVFGVRNAKTGAAGSLMDVL

HYPGMNHRVEITEGILADECAALLCYFFRMPRQVFNAQKKAQSSTDSGGSSGGS

SGSETPGTSESATPESSGGSSGGSKRNYILGLAIGITSVGYGIIDYETRDVIDAGVR

LFKEANVENNEGRRSKRGARRLKRRRRHRIQRVKKLLFDYNLLTDHSELSGINP

YEARVKGLSQKLSEEEFSAALLHLAKRRGVHNVNEVEEDTGNELSTKEQISRNS

KALEEKYVAELQLERLKKDGEVRGSINRFKTSDYVKEAKQLLKVQKAYHQLDQ

SFIDTYIDLLETRRTYYEGPGEGSPFGWKDIKEWYEMLMGHCTYFPEELRSVKY

AYNADLYNALNDLNNLVITRDENEKLEYYEKFQIIENVFKQKKKPTLKQIAKEIL

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK

GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

-continued

```
LNGLYDKDNDKLKKLINKSPEKLLMYHHDPQTYQKLKLIMEQYGDEKNPLYKY

YEETGNYLTKYSKKDNGPVIKKIKYYGNKLNAHLDITDDYPNSRNKVVKLSLKP

YRFDVYLDNGVYKFVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKVS

SGNSNANSRGPSFSSGLVPLSLRGSHSRPGERPFQCRICMRNFSRGEHLRQHTRT

HTGEKPFQCRICMRNFSQSGTLKRHLRTHTGEKPFQCRICMRNFSRNDKLVPHL

KTHLRGSSAQ.
```

104. The modified cell of any one embodiments 63-103, wherein the guide polynucleotide comprises two individual polynucleotides, wherein the two individual polynucleotides are two DNAs, two RNAs or a DNA and an RNA.

105. The modified cell of any one of embodiments 63-104, wherein the guide polynucleotides comprise a crRNA and a tracrRNA, wherein the crRNA comprises a nucleic acid sequence complementary to a target sequence in the MECP2 polynucleotide.

106. The modified cell of embodiment 105, wherein the target sequence comprises sequence selected from the group consisting of CCATGTCCAGCCTTCAGGCA (SEQ ID NO: 141), TCCATGTCCAGCCTTCAGGC (SEQ ID NO: 142), TTCCATGTCCAGCCTTCAGG (SEQ ID NO: 143), GCTTCCATGTCCAGCCTTCA (SEQ ID NO: 144), CTTCCATGTCCAGCCTTCAGG (SEQ ID NO: 145), AGCTTCCATGTCCAGCCTTCAGG (SEQ ID NO: 146), AGCTTCCATGTCCAGCCTTC (SEQ ID NO: 147), CTTAAGCTTCCATGTCCAGC (SEQ ID NO: 148), AGCAAAAGGCTTTTCCCTGG (SEQ ID NO: 149), GAGCAAAAGGCTTTTCCCTG (SEQ ID NO: 150), AGAGCAAAAGGCTTTTCCCT (SEQ ID NO: 151), TAGAGCAAAAGGCTTTTCCC (SEQ ID NO: 152), TAGAGCAAAAGGCTTTTCCCT (SEQ ID NO: 153), TTTAGAGCAAAAGGCTTTTCCCT (SEQ ID NO: 154), CCATGAAGTCAAAATCATTA (SEQ ID NO: 155), ACCATGAAGTCAAAATCATT (SEQ ID NO: 156), TACCATGAAGTCAAAATCAT (SEQ ID NO: 157), TTACCATGAAGTCAAAATCAT (SEQ ID NO: 158), AGTTACCATGAAGTCAAAATCAT (SEQ ID NO: 159), CTTTTCACTTCCTGCCGGGG (SEQ ID NO: 160), TCAGCCCCGTTTCTTGGGAA (SEQ ID NO: 161), GCTTTCAGCCCCGTTTCTTG (SEQ ID NO: 162), CGGCTTTCAGCCCCGTTTCTT (SEQ ID NO: 163), CCCGGCTTTCAGCCCCGTTTCTT (SEQ ID NO: 164), GCACTTCTTGATGGGGAGTA (SEQ ID NO: 165), TCTTGCACTTCTTGATGGGG (SEQ ID NO: 166), CTTGCACTTCTTGATGGGGAG (SEQ ID NO: 167), and GTCTTGCACTTCTTGATGGGGAG (SEQ ID NO: 168).

107. The modified cell of embodiment 105 or 106, wherein the base editor system comprises a single guide RNA (sgRNA).

108. The modified cell of embodiment 107, wherein the sgRNA comprises

```
                                  (SEQ ID NO: 169)
CUUUUCACUUCCUGCCGGGG.
```

109. A base editor system comprising
a guide polynucleotide or a nucleic acid encoding the guide polynucleotide;
a polynucleotide programmable DNA binding domain or a nucleic acid encoding the polynucleotide programmable DNA binding domain, and
an adenosine deaminase domain or a nucleic acid encoding the adenosine deaminase domain,
wherein the guide polynucleotide is capable of targeting the base editor system to effect an A•T to G•C alteration of a single nucleotide polymorphism (SNP) causative of Rett Syndrome (RTT) in a MECP2 polynucleotide.

110. A base editor system comprising
a guide polynucleotide or a nucleic acid encoding the guide polynucleotide;
a polynucleotide programmable DNA binding domain or a nucleic acid encoding the polynucleotide programmable DNA binding domain, and
an adenosine deaminase domain or a nucleic acid encoding the adenosine deaminase domain,
wherein the guide polynucleotide is capable of targeting the base editor system to effect an A•T to G•C alteration of a single nucleotide polymorphism (SNP) causative of Rett Syndrome (RTT) in a MECP2 polynucleotide,
wherein the MECP2 polypeptide encodes a MECP2 protein comprising a pathogenic amino acid comprising a tryptophan at position 106, a cysteine at position 133, a stop codon at position 255, a stop codon at position 270, or a cysteine at position 306 resulted from the SNP, wherein the A•T to G•C alteration substitutes the pathogenic amino acid with a wild type amino acid.

111. The base editor system of embodiment 109, wherein MECP2 polynucleotide encodes an MECP2 protein comprising a pathogenic amino acid comprising a tryptophan at position 106, a cysteine at position 133, a stop codon at position 255, a stop codon at position 270, or a cysteine at position 306 resulted from the SNP.

112. The base editor system of embodiment 111, wherein the A•T to G•C alteration substitutes the pathogenic amino acid with a wild type amino acid.

113. The base editor system of any one of embodiments 110-112, wherein the wild type amino acid is an arginine.

114. The base editor system of embodiment 113, wherein the the A•T to G•C alteration substitutes a stop codon at position 255 of the MECP2 protein with an arginine 115. The base editor system of embodiment 114, wherein the SNP is at position 763 of the MECP2 polynucleotide.

116. The base editor system of any one of embodiments 109-115, wherein the polynucleotide programmable DNA binding domain is a Cas9 domain.
117. The base editor system of embodiment 116, wherein the Cas9 domain is a nuclease inactive Cas9 domain.
118. The base editor system of embodiment 117, wherein the Cas9 domain is a Cas9 nickase domain.
119. The method of any one of embodiments 116-118, wherein the Cas9 domain comprises a SpCas9 domain 120. The base editor system of embodiment 119, wherein the SpCas9 domain comprises a D10A and/or a H840A amino acid substitution or corresponding amino acid substitutions thereof.
121. The base editor system of embodiment 119 or 120, wherein the SpCas9 domain has specificity for a NGG PAM.
122. The base editor system of any one of embodiments 119-121, wherein the SpCas9 domain has specificity for a NGA PAM, a NGT PAM, or a NGC PAM.
123. The base editor system of any one of embodiments 119-121, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, R1335Q, T1337I, T1337V, T1337F, and T1337M or corresponding amino acid substitutions thereof.
124. The base editor system of any one of embodiments 119-121, wherein the SpCas9 domain comprises amino acid substitutions L1111R, D1135V, G1218R, E1219F, A1322R, R1335V, T1337R and one or more of L1111, D1135L, S1136R, G1218S, E1219V, D1332A, D1332S, D1332T, D1332V, D1332L, D1332K, D1332R, R1335Q, T13371, T1337V, T1337F, T1337S, T1337N, T1337K, T1337R, T1337H, T1337Q, and T1337M or corresponding amino acid substitutions thereof.
125. The base editor system of any one of embodiments 119-121, wherein the SpCas9 domain comprises amino acid substitutions D1135L, S1136R, G1218S, E1219V, A1322R, R1335Q, T1337, and A1322R, and one or more of L1111, D1 135L, S1136R, G1218S, E1219V, D1332A, D1332S, D1332T, D1332V, D1332L, D1332K, D1332R, R1335Q, T13371, T1337V, T1337F, T1337S, T1337N, T1337K, T1337R, T1337H, T1337Q, and T1337M or corresponding amino acid substitutions thereof.
126. The base editor system of any one of embodiments 119-121, wherein the SpCas9 domain comprises amino acid substitutions D1135M, S1136Q, G1218K, E1219F, A1322R, D1332A, R1335E, and T1337R, or corresponding amino acid substitutions thereof.
127. The base editor system of any one of embodiments 119 or 120, wherein the SpCas9 domain has specificity for a NG PAM, a NNG PAM, a GAA PAM, a GAT PAM, or a CAA PAM.
128. The base editor system of embodiment 127, wherein the Cas9 domain comprises amino acid substitutions E480K, E543K, and E1219V or corresponding amino acid substitutions thereof.
129. The base editor system of any one of embodiments 116-118, wherein the Cas9 domain comprises a SaCas9 domain.
130. The base editor system of embodiment 129, wherein the SaCas9 domain has specificity for a NNNRRT PAM.
131. The base editor system of embodiment 130, wherein the Sa Cas9 domain has specificity for a NNGRRT PAM.
132. The base editor system of any one of embodiments 129-131, wherein the SaCas9 domain comprises an amino acid substitution N579A or a corresponding amino acid substitution thereof.
133. The base editor system of any one of embodiments 129-132, wherein the SaCas9 domain comprises amino acid substitutions E782K, N968K, and RIO15H, or corresponding amino acid substitutions thereof.
134. The base editor system of any one of embodiments 116-118, wherein the Cas9 domain comprises a St1Cas9 domain.
135. The base editor system of embodiment 134, wherein the St1Cas9 domain has specificity for a NNACCA PAM.
136. The base editor system of any one of embodiments 109-135, wherein the adenosine deaminase domain is a modified adenosine deaminase domain that does not occur in nature.
137. The base editor system of embodiment 136, wherein the adenosine deaminase domain comprises a TadA domain.
138. The base editor system of embodiment 137, wherein the TadA domain comprises the amino acid sequence of TadA 7.10.
139. The base editor system of any one of embodiments 109-138, wherein the base editor system further comprises a zinc finger domain.
140. The base editor system of embodiment 139, wherein the zinc finger domain comprises recognition helix sequences RNEHLEV (SEQ ID NO: 131), QSTTLKR (SEQ ID NO: 132), and RTEHLAR (SEQ ID NO: 133) or recognition helix sequences RGEHLRQ (SEQ ID NO: 134), QSGTLKR (SEQ ID NO: 135), and RNDKLVP (SEQ ID NO: 136).
141. The base editor system of embodiment 139 or 140, wherein the zinc finger domain is zflra or zflrb.
142. The base editor system of any one of embodiments 109-141, wherein the base editor system further comprises a nuclear localization signal (NLS).
143. The base editor system of any one embodiments 109-142, wherein the base editor system further comprises one or more linkers.
144. The base editor system of embodiment 143, wherein two or more of the polynucleotide programmable DNA binding domain, the adenosine deaminase domain, the zinc finger domain, and the NLS are connected via a linker.
145. The base editor system of embodiment 144, wherein the linker is a peptide linker, thereby forming a base editing fusion protein.
146. The base editor system of embodiment 145, wherein the peptide linker comprises an amino acid sequence selected from the group consisting of

SGGSSGSETPGTSESATPESSGGS (SEQ ID NO: 23),

SGGSSGGSSGSETPGTSESATPESSGGSSGGS
(SEQ ID NO: 24),

GGSGGSPGSPAGSPTSTEEGTSESATPESGPGTSTEPSEG

SAPGSPAGSPTSTEEGTSTEPSEGSAPGTSTEPSEGSAPG

TSESATPESGPGSEPATSGGSGGS (SEQ ID NO: 25),

-continued

SGGSSGGSSGSETPGTSESATPES (SEQ ID NO: 26),

SGGSSGGSSGSETPGTSESATPESSGGSSGGSSGGSSGGS (SEQ ID NO: 27),

SGGSSGGSSGSETPGTSESATPESSGGSSGGSSGGSSGGS

SGSETPGTSESATPESSGGSSGGS (SEQ ID NO: 28),

PGSPAGSPTSTEEGTSESATPESGPGTSTEPSEGSAPGSP

AGSPTSTEEGTSTEPSEGSAP GTSTEPSEGSAPGTSESATPES

GPGSEPATS (SEQ ID NO: 29),

-continued (SGGS)n (SEQ ID NO: 8), (GGGS)n (SEQ ID NO: 127), (GGGGS)n (SEQ ID NO: 128), (G)n, (EAAAK)n (SEQ ID NO: 129), (GGS)n, SGSETPGTSESATPES (SEQ ID NO: 7), and (XP)n.

147. The base editor system of embodiment 145 or 146, wherein the base editing fusion protein comprises the amino acid sequence selected from the group consisting of (SEQ ID NO: 137)

MPKKKRKVSEVEFSHEYWMRHALTLAKRAWDEREVPVGAVLVHNNRVIGEG

WNRPIGRHDPTAHAEIMALRQGGLVMQNYRLIDATLYVTLEPCVMCAGAMIHS

RIGRVVFGARDAKTGAAGSLMDVLHHPGMNHRVEITEGILADECAALLSDFFR

MRRQEIKAQKKAQSSTDSGGSSGGSSGSETPGTSESATPESSGGSSGGSSEVEFSH

EYWMRHALTLAKRARDEREVPVGAVLVLNNRVIGEGWNRAIGLHDPTAHAEI

MALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSS

TDSGGSSGGSSGSETPGTSESATPESDLVLGLAIGIGSVGVGILNKVTGEIIHKNSR

IFPAAQAENNLVRRTNRQGRRLARRKKHRRVRLNRLFEESGLITDFTKISINLNPY

QLRVKGLTDELSNEELFIALKNMVKHRGISYLDDASDDGNSSVGDYAQIVKENS

KQLETKTPGQIQLERYQTYGQLRGDFTVEKDGKKHRLINVFPTSAYRSEALRILQ

TQQEFNPQITDEFINRYLEILTGKRKYYHGPGNEKSRTDYGRYRTSGETLDNIFGI

LIGKCTFYPDEFRAAKASYTAQEFNLLNDLNNLTVPTETKKLSKEQKNQIINYVK

NEKAMGPAKLFKYIAKLLSCDVADIKGYRIDKSGKAEIHTFEAYRKMKTLETLDI

EQMDRETLDKLAYVLTLNTEREGIQEALEHEFADGSFSQKQVDELVQFRKANSS

IFGKGWHNFSVKLMMELIPELYETSEEQMTILTRLGKQKTTSSSNKTKYIDEKLL

TEEIYNPVVAKSVRQAIKIVNAAIKEYGDFDNIVIEMARETNEDDEKKAIQKIQK

ANKDEKDAAMLKAANQYNGKAELPHSVFHGHKQLATKIRLWHQQGERCLYTG

KTISIHDLINNSNQFEVDHILPLSITFDDSLANKVLVYATANQEKGQRTPYQALDS

MDDAWSFRELKAFVRESKTLSNKKKEYLLTEEDISKFDVRKKFIERNLVDTLYA

SRVVLNALQEHFRAHKIDTKVSVVRGQFTSQLRRHWGIEKTRDTYHHHAVDALI

IAASSQLNLWKKQKNTLVSYSEDQLLDIETGELISDDEYKESVFKAPYQHFVDTL

KSKEFEDSILFSYQVDSKFNRKISDATIYATRQAKVGKDKADETYVLGKIKDIYT

QDGYDAFMKIYKKDKSKFLMYRHDPQTFEKVIEPILENYPNKQINDKGKEVPCN

PFLKYKEEHGYIRKYSKKGNGPEIKSLKYYDSKLGNHIDITPKDSNNKVVLQSVS

PWRADVYFNKTTGKYEILGLKYADLQFDKGTGTYKISQEKYNDIKKKEGVDSD

SEFKFTLYKNDLLLVKDTETKEQQLFRFLSRTMPKQKHYVELKPYDKQKFEGGE

ALIKVLGNVANSGQCKKGLGKSNISIYKVRTDVLGNQHIIKNEGDKPKLDFPKK

KRKVEGADKRTADGSEFESPKKKRKV,

-continued (SEQ ID NO: 138)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMIRRQEIKA
QKKAQSSTDSGGSSGGSSGSETPGTSESATPESSGGSSGGSSEVEFSHEYWMRHA
LTLAKRARDEREVPVGAVLVLNNRVIGEGWNRAIGLHDPTAHAEIMALRQGGL
VMQNYRLIDATLYVTFEPCVMCAGAMIHSRIGRVVFGVRNAKTGAAGSLMDVL
HYPGMNHRVEITEGILADECAALLCYFFRMPRQVFNAQKKAQSSTDSGGSSGGS
SGSETPGTSESATPESSGGSSGGSKRNYILGLAIGITSVGYGIIDYETRDVIDAGVR
LEKEANVENNEGRRSKRGARRLKRRRRHRIQRVKKLLFDYNLLTDHSELSGINP
YEARVKGLSQKLSEEEFSAALLHLAKRRGVHNVNEVEEDTGNELSTKEQISRNS
KALEEKYVAELQLERLKKDGEVRGSINRFKTSDYVKEAKQLLKVQKAYHQLDQ
SFIDTYIDLLETRRTYYEGPGEGSPFGWKDIKEWYEMLMGHCTYFPEELRSVKY
AYNADLYNALNDLNNLVITRDENEKLEYYEKFQIIENVFKQKKKPTLKQIAKEIL
VNEEDIKGYRVTSTGKPEFTNLKVYHDIKDITARKEIIENAELLDQIAKILTIYQSS
EDIQEELTNLNSELTQEEIEQISNLKGYTGTHNLSLKAINLILDELWHTNDNQIAIF
NRLKLVPKKVDLSQQKEIPTTLVDDFILSPVVKRSFIQSIKVINAIIKKYGLPNDIII
ELAREKNSKDAQKMINEMQKRNRQTNERIEEIIRTTGKENAKYLIEKIKLHDMQE
GKCLYSLEAIPLEDLLNNPFNYEVDHIIPRSVSFDNSFNNKVLVKQEENSKKGNR
TPFQYLSSSDSKISYETFKKHILNLAKGKGRISKTKKEYLLEERDINRFSVQKDFIN
RNLVDTRYATRGLMNLLRSYFRVNNLDVKVKSINGGFTSFLRRKWKFKKERNK
GYKHHAEDALIIANADFIFKEWKKLDKAKKVMENQMFEEKQAESMPEIETEQE
YKEIFITPHQIKHIKDFKDYKYSHRVDKKPNRKLINDTLYSTRKDDKGNTLIVNN
LNGLYDKDNDKLKKLINKSPEKLLMYHHDPQTYQKLKLIMEQYGDEKNPLYKY
YEETGNYLTKYSKKDNGPVIKKIKYYGNKLNAHLDITDDYPNSRNKVVKLSLKP
YREDVYLDNGVYKEVTVKNLDVIKKENYYEVNSKCYEEAKKLKKISNQAEFIAS
FYKNDLIKINGELYRVIGVNNDLLNRIEVNMIDITYREYLENMNDKRPPHIIKTIA
SKTQSIKKYSTDILGNLYEVKSKKHPQIIKKGEGADKRTADGSEFESPKKKRKV, (SEQ ID NO: 139)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMIRRQEIKA
QKKAQSSTDSGGSSGGSSGSETPGTSESATPESSGGSSGGSSEVEFSHEYWMRHA
LTLAKRARDEREVPVGAVLVLNNRVIGEGWNRAIGLHDPTAHAEIMALRQGGL
VMQNYRLIDATLYVTFEPCVMCAGAMIHSRIGRVVFGVRNAKTGAAGSLMDVL
HYPGMNHRVEITEGILADECAALLCYFFRMPRQVFNAQKKAQSSTDSGGSSGGS
SGSETPGTSESATPESSGGSSGGSKRNYILGLAIGITSVGYGIIDYETRDVIDAGVR
LEKEANVENNEGRRSKRGARRLKRRRRHRIQRVKKLLFDYNLLTDHSELSGINP
YEARVKGLSQKLSEEEFSAALLHLAKRRGVHNVNEVEEDTGNELSTKEQISRNS
KALEEKYVAELQLERLKKDGEVRGSINRFKTSDYVKEAKQLLKVQKAYHQLDQ
SFIDTYIDLLETRRTYYEGPGEGSPFGWKDIKEWYEMLMGHCTYFPEELRSVKY
AYNADLYNALNDLNNLVITRDENEKLEYYEKFQIIENVFKQKKKPTLKQIAKEIL -continued

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK

GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

LNGLYDKDNDKLKKLINKSPEKLLMYHHDPQTYQKLKLIMEQYGDEKNPLYKY

YEETGNYLTKYSKKDNGPVIKKIKYYGNKLNAHLDITDDYPNSRNKVVKLSLKP

YREDVYLDNGVYKEVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKVS

SGNSNANSRGPSFSSGLVPLSLRGSHSRPGERPFQCRTCMRNFSRNEHLEVHTRT

HTGEKPFQCRTCMRNFSQSTTLKRHLRTHTGEKPFQCRTCMRNFSRTEHLARHLK

THLRGSSAQ,
or (SEQ ID NO: 140)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHA

LTLAKRARDEREVPVGAVLVLNNRVIGEGWNRAIGLHDPTAHAEIMALRQGGL

VMQNYRLIDATLYVTFEPCVMCAGAMIHSRIGRVVFGVRNAKTGAAGSLMDVL

HYPGMNHRVEITEGILADECAALLCYFFRMPRQVFNAQKKAQSSTDSGGSSGGS

SGSETPGTSESATPESSGGSSGGSKRNYILGLAIGITSVGYGIIDYETRDVIDAGVR

LEKEANVENNEGRRSKRGARRLKRRRRHRIQRVKKLLFDYNLLTDHSELSGINP

YEARVKGLSQKLSEEEFSAALLHLAKRRGVHNVNEVEEDTGNELSTKEQISRNS

KALEEKYVAELQLERLKKDGEVRGSINRFKTSDYVKEAKQLLKVQKAYHQLDQ

SFIDTYIDLLETRRTYYEGPGEGSPFGWKDIKEWYEMLMGHCTYFPEELRSVKY

AYNADLYNALNDLNNLVITRDENEKLEYYEKFQIIENVFKQKKKPTLKQIAKEIL

VNEEDIKGYRVTSTGKPEFTNLKVYHDIKDITARKEIIENAELLDQIAKILTIYQSS

EDIQEELTNLNSELTQEEIEQISNLKGYTGTHNLSLKAINLILDELWHTNDNQIAIF

NRLKLVPKKVDLSQQKEIPTTLVDDFILSPVVKRSFIQSIKVINAIIKKYGLPNDIII

ELAREKNSKDAQKMINEMQKRNRQTNERIEEIIRTTGKENAKYLIEKIKLHDMQE

GKCLYSLEAIPLEDLLNNPFNYEVDHIIPRSVSFDNSFNNKVLVKQEENSKKGNR

TPFQYLSSSDSKISYETFKKHILNLAKGKGRISKTKKEYLLEERDINRFSVQKDFIN

RNLVDTRYATRGLMNLLRSYFRVNNLDVKVKSINGGFTSFLRRKWKFKKERNK

GYKHHAEDALIIANADFIFKEWKKLDKAKKVMENQMFEEKQAESMPEIETEQE

YKEIFITPHQIKHIKDFKDYKYSHRVDKKPNRKLINDTLYSTRKDDKGNTLIVNN

-continued

```
LNGLYDKDNDKLKKLINKSPEKLLMYHHDPQTYQKLKLIMEQYGDEKNPLYKY

YEETGNYLTKYSKKDNGPVIKKIKYYGNKLNAHLDITDDYPNSRNKVVKLSLKP

YREDVYLDNGVYKEVTVKNLDVIKKENYYEVNSKCYEEAKKLKKISNQAEFIAS

FYKNDLIKINGELYRVIGVNNDLLNRIEVNMIDITYREYLENMNDKRPPHIIKTIA

SKTQSIKKYSTDILGNLYEVKSKKHPQIIKKGEGADKRTADGSEFESPKKKRKVS

SGNSNANSRGPSFSSGLVPLSLRGSHSRPGERPFQCRICMRNFSRGEHLRQHTRT

HTGEKPFQCRICMRNFSQSGTLKRHLRTHTGEKPFQCRICMRNFSRNDKLVPHL

KTHLRGSSAQ.
```

148. The base editor system of any one embodiments 109-147, wherein the guide polynucleotide comprises two individual polynucleotides, wherein the two individual polynucleotides are two DNAs, two RNAs or a DNA and an RNA.

149. The base editor system of any one of embodiments 109-148, wherein the guide polynucleotides comprise a crRNA and a tracrRNA, wherein the crRNA comprises a nucleic acid sequence complementary to a target sequence in the MECP2 polynucleotide.

150. The base editor system of embodiment 149, wherein the target sequence comprises sequence selected from the group consisting of CCATGTCCAGCCTTCAGGCA (SEQ ID NO: 141), TCCATGTCCAGCCTTCAGGC (SEQ ID NO: 142), TTCCATGTCCAGCCTTCAGG (SEQ ID NO: 143), GCTTCCATGTCCAGCCTTCA (SEQ ID NO: 144), CTTCCATGTCCAGCCTTCAGG (SEQ ID NO: 145), AGCTTCCATGTCCAGCCTTCAGG (SEQ ID NO: 146), AGCTTCCATGTCCAGCCTTC (SEQ ID NO: 147), CTTAAGCTTCCATGTCCAGC (SEQ ID NO: 148), AGCAAAAGGCTTTTCCCTGG (SEQ ID NO: 149), GAGCAAAAGGCTTTTCCCTG (SEQ ID NO: 150), AGAGCAAAAGGCTTTTCCCT (SEQ ID NO: 151), TAGAGCAAAAGGCTTTTCCC (SEQ ID NO: 152), TAGAGCAAAAGGCTTTTCCCT (SEQ ID NO: 153), TTTAGAGCAAAAGGCTTTTCCCT (SEQ ID NO: 154), CCATGAAGTCAAAATCATTA (SEQ ID NO: 155), ACCATGAAGTCAAAATCATT (SEQ ID NO: 156), TACCATGAAGTCAAAATCAT (SEQ ID NO: 157), TTACCATGAAGTCAAAATCAT (SEQ ID NO: 158), AGTTACCATGAAGTCAAAATCAT (SEQ ID NO: 159), CTTTTCACTTCCTGCCGGGG (SEQ ID NO: 160), TCAGCCCCGTTTCTTGGGAA (SEQ ID NO: 161), GCTTTCAGCCCCGTTTCTTG (SEQ ID NO: 162), CGGCTTTCAGCCCCGTTTCTT (SEQ ID NO: 163), CCCGGCTTTCAGCCCCGTTTCTT (SEQ ID NO: 164), GCACTTCTTGATGGGGAGTA (SEQ ID NO: 165), TCTTGCACTTCTTGATGGGG (SEQ ID NO: 166), CTTGCACTTCTTGATGGGGAG (SEQ ID NO: 167), and GTCTTGCACTTCTTGATGGGGAG (SEQ ID NO: 168).

151. The base editor system of embodiment 149 or 150, wherein the base editor system comprises a single guide RNA (sgRNA).

152. The base editor system of embodiment 151, wherein the sgRNA comprises

```
                                        (SEQ ID NO: 169)
CUUUUCACUUCCUGCCGGGG.
```

EXAMPLES

These examples are provided for illustrative purposes only and not to limit the scope of the claims provided herein.

Example 1. A•T to G•C DNA Base Editing for Correction of Mecp2 RTT-Associated Mutations in Cells Six of the eight most prevalent RTT-causing Mecp2 mutations were targeted for reversion to wild-type sequence using A•T to G•C DNA base editors (ABEs) that employ Cas9 moieties with validated protospacer adjacent motif (PAM) sequence preferences. To determine which guide RNA (gRNA) and ABE-Cas9 platform is able to most efficiently and precisely correct a targeted Mecp2 mutation, an Mecp2 allele bearing RTT targetable mutations (Table 66), including R255X was genomically integrated in HEK293T cells by lentivirus transduction. Editing efficiencies of gRNAs and ABE-Cas9 editors for a given mutation were measured. Five days after transfection of DNA encoding ABE-Cas9 editors and gRNAs, cells were lysed and analyzed for base editing at the desired site by MISEQ® high-throughput DNA sequencer analysis.

TABLE 6

6 RTT mutations.

| Causal mutation | SEQ ID NO: | Target sequence | PAM | | Cas9 PAM-enabling mutations | editing position |
|---|---|---|---|---|---|---|
| c.316C>T | 141 | CCATGTCCAGCCTTCAGGCA | GGG | SpCas9 | | 3 |
| (2.77%) | 142 | TCCATGTCCAGCCTTCAGGC | AGG | SpCas9 | | 4 |
| R106W | 143 | TTCCATGTCCAGCCTTCAGG | CAG | SpCas9 | xCas9 | 5 |
| | 144 | GCTTCCATGTCCAGCCTTCA | GGC | SpCas9 | MQKSER/ICKSER/VRKSER; Nureki | 7 |
| | 145 | CTTCCATGTCCAGCCTTCAGG | CAGGGT | SaCas9 | | 6 |
| | 146 | AGCTTCCATGTCCAGCCTTCAGG | CAGGGT | SaCas9 | | 8 |

TABLE 6-continued

6 RTT mutations.

| Causal mutation | SEQ ID NO: | Target sequence | PAM | | Cas9 PAM-enabling mutations | editing position |
|---|---|---|---|---|---|---|
| | 147 | AGCTTCCATGTCCAGCCTTC | CTTA | Cpf1 | | 8 |
| | 148 | CTTAAGCTTCCATGTCCAGC | TTTG | Cpf1 | | 12 |
| c.397C>T | 149 | AGCAAAAGGCTTTTCCCTGG | GGA | SpCas9 | VRQR | 4 |
| (4.56%) | 150 | GAGCAAAAGGCTTTTCCCTG | GGG | SpCas9 | | 5 |
| R133C | 151 | AGAGCAAAAGGCTTTTCCCT | GGG | SpCas9 | | 6 |
| | 152 | TAGAGCAAAAGGCTTTTCCC | TGG | SpCas9 | | 7 |
| | 153 | TAGAGCAAAAGGCTTTTCCCT | GGGGAT | SaCas9 | | 7 |
| | 154 | TTTAGAGCAAAAGGCTTTTCCCT | GGGGAT | SaCas9 | | 9 |
| c.473C>T | 155 | CCATGAAGTCAAAATCATTA | GGG | SpCas9 | | 3 |
| (8.81%) | 156 | ACCATGAAGTCAAAATCATT | AGG | SpCas9 | | 4 |
| T158M | 157 | TACCATGAAGTCAAAATCAT | TAG | SpCas9 | xCas9; ScCas9 | 5 |
| | 158 | TTACCATGAAGTCAAAATCAT | TAGGGT | SaCas9 | | 6 |
| | 159 | AGTTACCATGAAGTCAAAATCAT | TAGGGT | SaCas9 | | 8 |
| c.763C>T (6.68%) R255X | 160 | CTTTTCACTTCCTGCCGGGG | CGT | SpCas9 | LRSVQL/LRKIQK/ LRSVQK; Nureki | 7 |
| c.808C>T | 161 | TCAGCCCCGTTTCTTGGGAA | TGG | SpCas9 | | 3 |
| (5.8%) | 162 | GCTTTCAGCCCCGTTTCTTG | GGA | SpCas9 | VRQR | 7 |
| R270X | 163 | CGGCTTTCAGCCCCGTTTCTT | GGGAAT | SaCas9 | | 9 |
| | 164 | CCCGGCTTTCAGCCCCGTTTCTT | GGGAAT | SaCas9 | | 11 |
| c.916C>T | 165 | GCACTTCTTGATGGGGAGTA | CGG | SpCas9 | | 3 |
| (5.17%) R306C | 166 | TCTTGCACTTCTTGATGGGG | AGT | SpCas9 | LRSVQL/LRKIQK/ LRSVQK | 7 |
| | 167 | CTTGCACTTCTTGATGGGGAG | TACGGT | SaCas9 | KKH | 6 |
| | 168 | GTCTTGCACTTCTTGATGGGGAG | TACGGT | SaCas9 | KKH | 8 |

In one set of experiments, R255X was targeted using a gRNA comprising the nucleic acid sequence CUUUUCA-CUUCCUGCCGGGG (SEQ ID NO: 169), which targets the base editor to the nucleic acid sequence CTTTT-CACTTCCTGCCGGGG (SEQ ID NO: 160) comprising the RTT mutation 763C>T (R255X).

Adenosine deaminase base editors were created with specificity for NGT PAM having amino acid substitutions L1111R, D1135V, G1218R, E1219F, A1322R, R1335V, T1337R and one or more of L1111, D1135L, 51136R, G1218S, E1219V, D1332A, R1335Q, T13371, T1337V, T1337F, and T1337M in SpCas9. The base editors showed activity as measured by precise correction of R255X.

Adenosine deaminase base editors were created with specificity for NGT PAM having amino acid substitutions L1111R, D1135V, G1218R, E1219F, A1322R, R1335V, T1337R and one or more of L1111, D1135L, S1136R, G1218S, E1219V, D1332A, D1332S, D1332T, D1332V, D1332L, D1332K, D1332R, R1335Q, T1337I, T1337V, T1337F, T1337S, T1337N, T1337K, T1337H, T1337Q, and T1337M in SpCas9. The base editors showed activity as measured by precise correction of R255X (FIG. 1).

Figure 2:
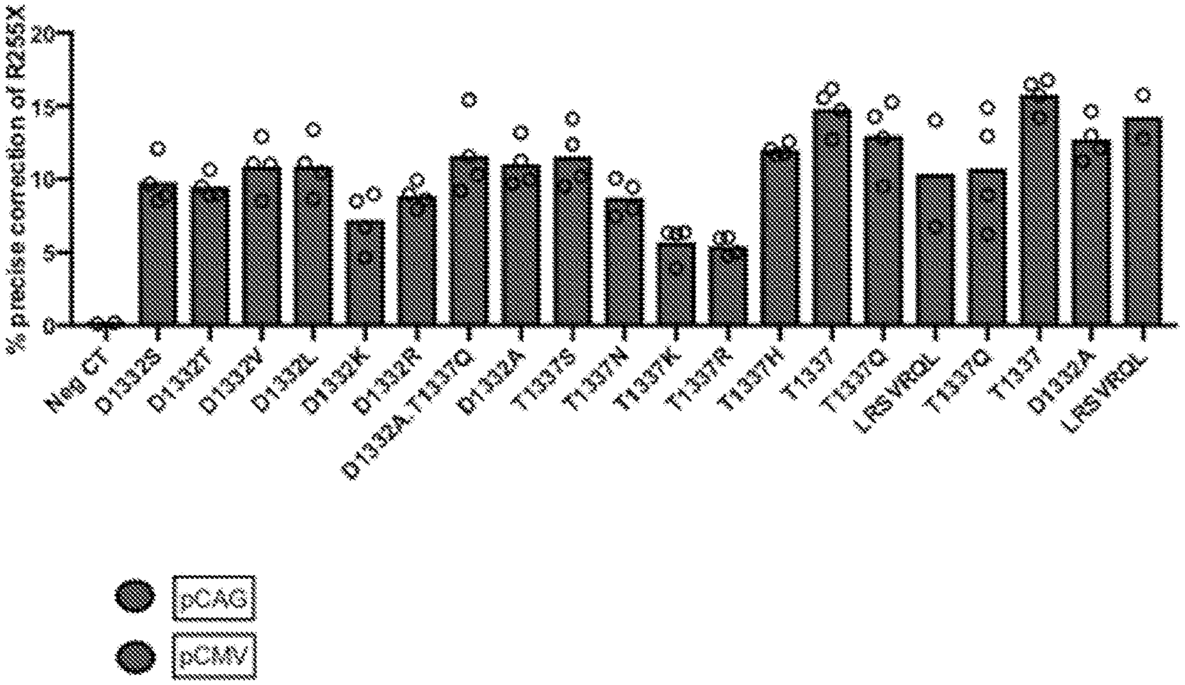
FIG. 2 is a graph depicting percentage of precise correction of R255X RTT mutation using base editor variants with specificity for NGT PAM.

Adenosine deaminase base editors were created with specificity for NGT PAM having amino acid substitutions D1135L, S1136R, G1218S, E1219V, A1322R, R1335Q, and T1337 and, and one or more of L1111R, D1332A, D1332S, D1332T, D1332V, D1332L, D1332K, D1332R, T1337, T1337I, T1337V, T1337F, T1337S, T1337N, T1337K, T1337R, T1337H, T1337Q, and T1337M in SpCas9. The base editors showed activity as measured by precise correction of R255X (FIG. 2). pCAG promoter was used for the data on the left (light gray) and pCMV promoter was used for the data on the right (dark gray).

Adenosine deaminase base editors with specificity for NGT PAM were generated as shown in Table 7.

TABLE 7

NGT PAM variant

| | NGTN variant | D1135 | S1136 | G1218 | E1219 | A1322R | R1335 | T1337 |
|---|---|---|---|---|---|---|---|---|
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

Figure 3:
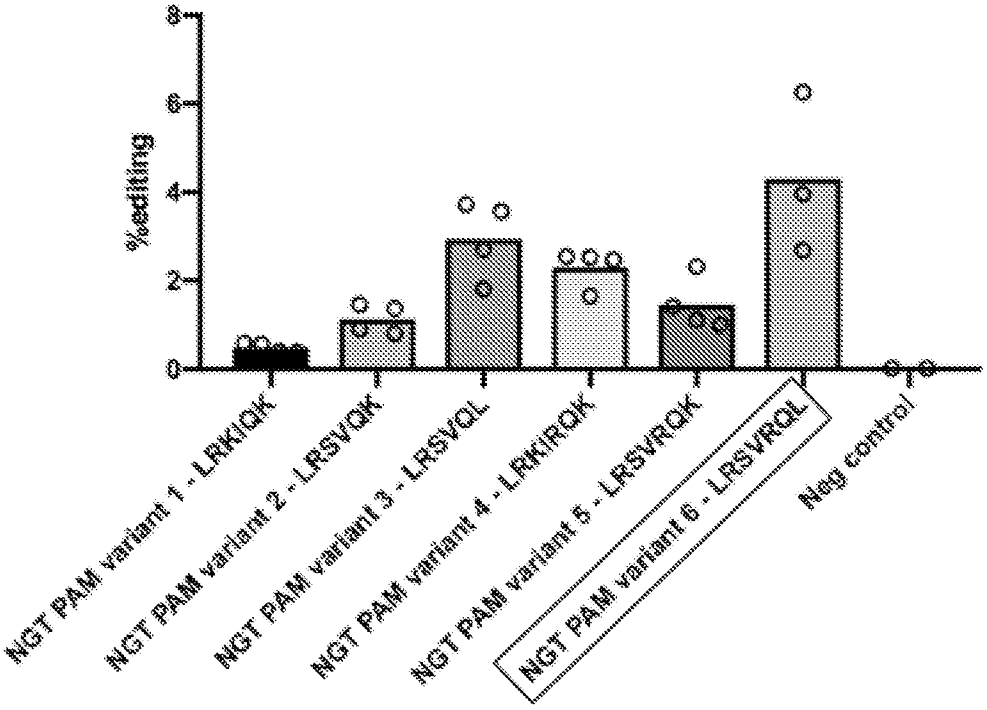
FIG. 3 is a graph depicting PAM variant optimization with the amino acid substitution T1337L. Percentage of precise correction of R255X RTT mutation is shown using base editor variants with specificity for NGT PAM.

The base editors showed activity as measured by precise correction of R255X (FIG. 3). In particular, variant 6, also termed LRSVRQL showed 4% base editing, the most of all the variants. Variant 6 contains A1322R and T1337L. Without being bound by theory, it was proposed that these amino acid substitutions were important for NGT PAM specificity.

Figure 4:
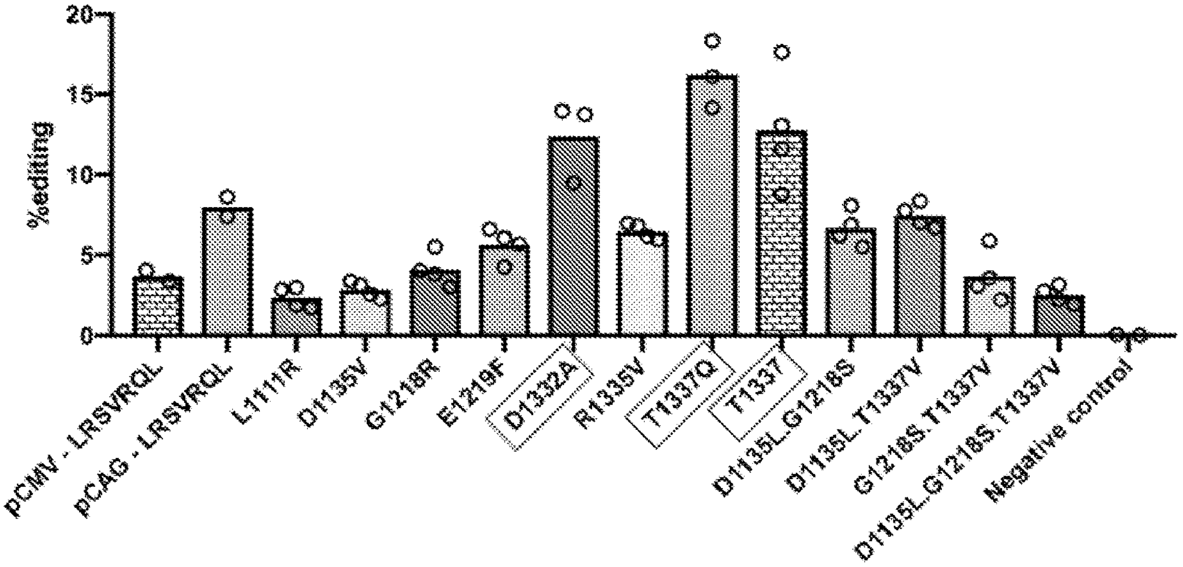
FIG. 4 is a graph depicting percentage of precise correction of R255X RTT mutation by PAM base editor variants with specificity for NGT PAM generated by shuffling mutations from other characterized PAM variants. T1337Q was identified as important for editing efficiency.

Additional mutations from other characterized PAM variants were introduced into PAM variant 6. Amino acid residue T1337 was identified as being important for editing (FIG. 4). PAM variants based on variant 6 and modified to have T1337Q and T1337 showed increased editing for correction of R255X, compared to T1337L. A PAM variant based on variant 6 and modified to have D1332A was also identified as having increased editing for correction of R255X compared to variant 6.

Figure 5:
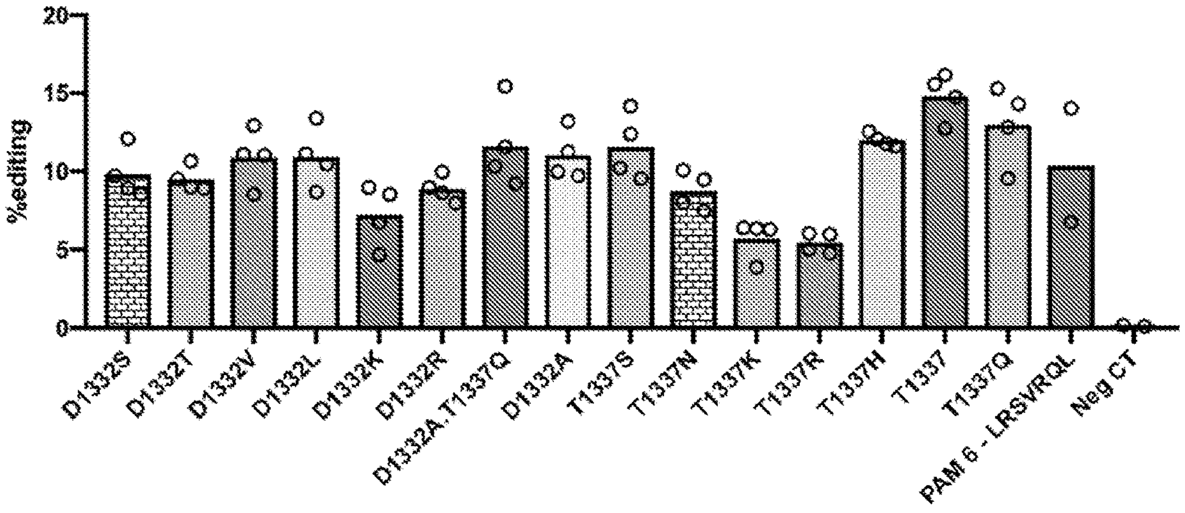
FIG. 5 is a graph depicting changes in base editing efficiency when T1337 and D1332 are substituted with other amino acids. Percentage of precise correction of R255X RTT mutation is shown using base editor variants with specificity for NGT PAM.

To characterize the residues at T1337 and D1332 further, different amino acids were tested at these two positions with regard to editing efficiency for correction of R255X. Compared to other substitutions at position 1337, T1337 and T1337Q were the most important residues for editing (FIG. 5).

Figure 6:
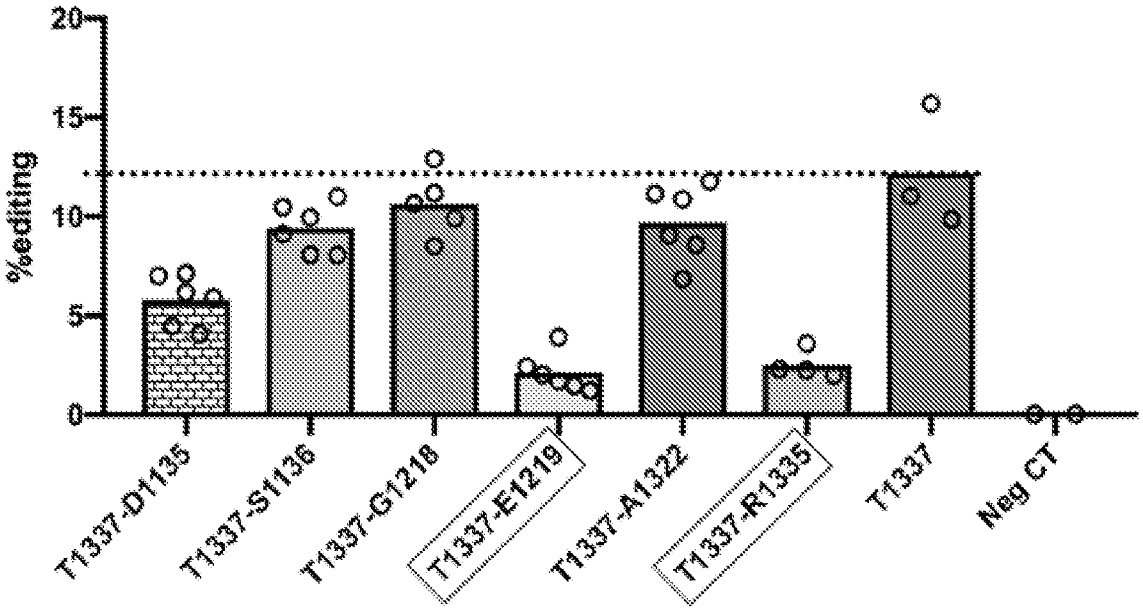
FIG. 6 is a graph depicting the importance of E1219V and R1335Q for base editing activity associated with T1337. Percentage of precise correction of R255X RTT mutation is shown using base editor variants with specificity for NGT PAM.

To evaluate T1337 specifically, individual amino acids in the PAM variants were reverted to wild-type. Without being bound by theory, this analysis can identify which residues are important for activity on NGT PAM. In particular, E1219V and R1335Q were shown to be important for activity associated with T1337, as reversion back to wild-type at each of these residues abolished significantly reduced editing (FIG. 6).

Molecular modeling was also used to yield a library of pairwise mutations for improved NGT PAM recognition. Amino acids were shuffled to create 55 new variants of PAM variant 6. Groups of mutation are depicted in Tables 8 and 9 below:

TABLE 8

| NGT PAM Variant Mutations at residues 1219, 1335, 1337, 1218 | | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |
| 24 | I | A | W | |
| 25 | I | A | F | |
| 26 | I | A | Y | |

TABLE 9

| NGT PAM Variant Mutations at residues 1135, 1136, 1218, 1219, and 1335 | | | | | |
|---|---|---|---|---|---|
| | D1135L | S1136R | G1218S | E1219V | R1335Q |
| 27 | G | | | | |
| 28 | V | | | | |
| 29 | I | | | | |
| 30 | | A | | | |
| 31 | | W | | | |
| 32 | | H | | | |
| 33 | | K | | | |
| 34 | | | K | | |
| 35 | | | R | | |
| 36 | | | Q | | |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |
| 46 | | | | T | |
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

Figure 7:
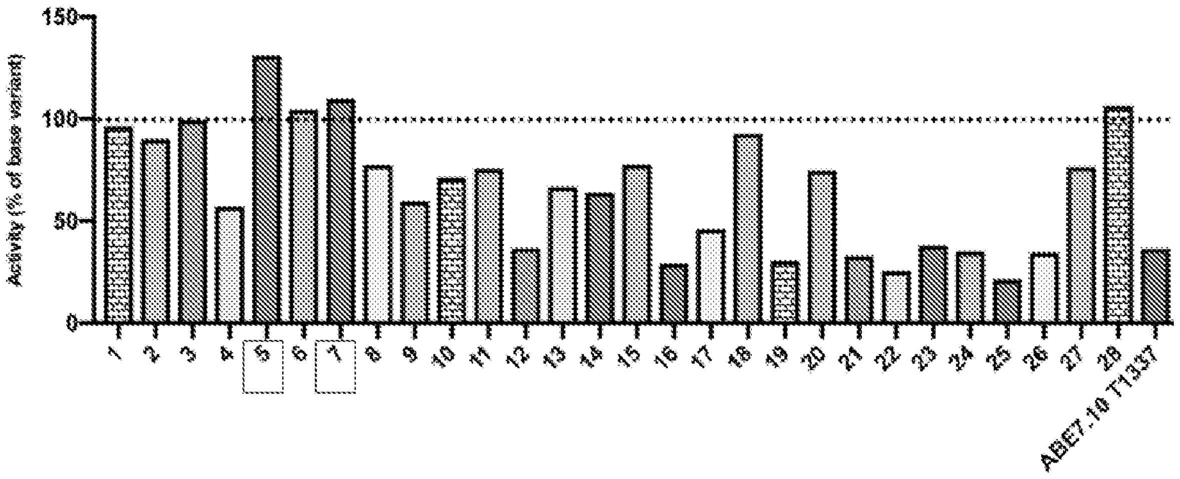
FIG. 7 is a graph depicting percentage of precise correction of R255X RTT mutation using PAM variant base editors with specificity for NGT PAM variants listed at Tables 8 and 9.
Figure 8:
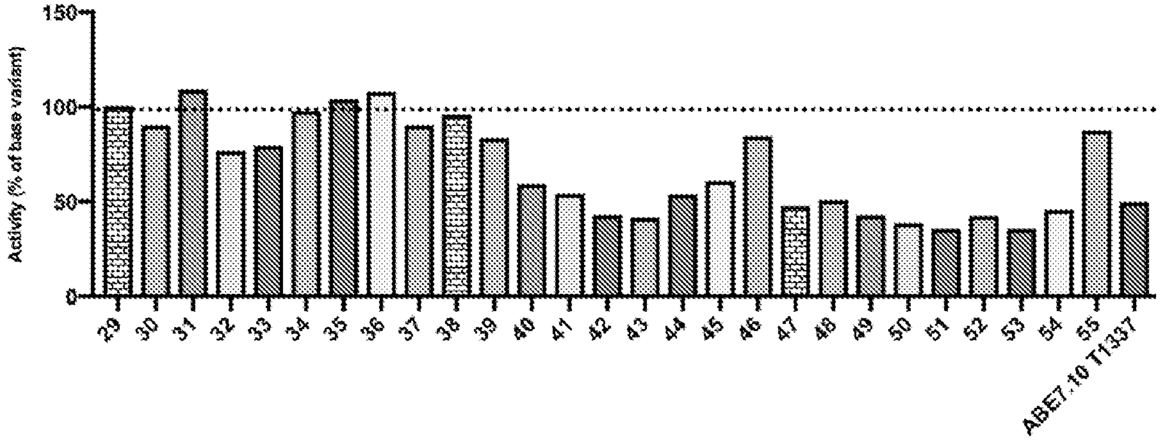
FIG. 8 is a graph depicting percentage of precise correction of R255X RTT mutation using PAM variant base editors with specificity for NGT PAM variants listed at Tables 8 and 9.

Targeted mutations for the 55 new PAM variants in Tables 8 and 9 reinforced the importance of T1337 (FIGS. 7 and 8). Variant 5 in Table 8 displayed significantly enhanced editing (FIG. 7). In particular, the sequence of variant 5 (Table 8) includes a reversion to T1337.

Additional pairwise mutations were generated for improved NGT PAM recognition, as shown in Table 10.

TABLE 10

| NGT PAM Variant Mutations at residues 1219, 1335, 1337, 1218 | | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

Figure 9:
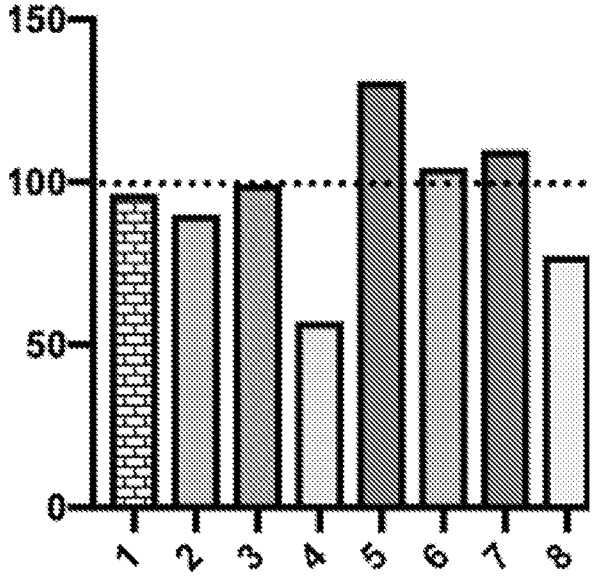
FIG. 9 is a graph depicting percentage of precise correction of R255X RTT mutation using PAM variant base editors with specificity for NGT PAM variants listed at Table 10.

Additional pairwise mutations were generated for improved NGT PAM recognition, as shown in Table 10. The substitution G1218R was additive for editing with E1219F, R1335V, and T1337 or T1337Q (FIG. 9).

Example 2. Materials and Methods

The results provided in the Examples described herein were obtained using the following materials and methods.

Cloning.

PCR was performed using VeraSeq ULtra DNA polymerase (Enzymatics), or Q5® Hot Start High-Fidelity DNA Polymerase (New England Biolabs). Base Editor (BE) plasmids were constructed using USER cloning (New England Biolabs). Deaminase genes were synthesized as GBLOCKS® Gene Fragments (Integrated DNA Technologies). Cas9 genes used are listed below. Cas9 genes were obtained from previously reported plasmids. Deaminase and fusion genes were cloned into pCMV (mammalian codon-optimized) or pET28b (*E. coli* codon-optimized) backbones. sgRNA expression plasmids were constructed using site-directed mutagenesis.

Briefly, the primers listed herein above were 5' phosphorylated using T4 Polynucleotide Kinase (New England Biolabs) according to the manufacturer's instructions. Next, PCR was performed using Q5® Hot Start High-Fidelity DNA Polymerase (New England Biolabs) with the phosphorylated primers and the plasmid encoding Mecp2 as a template according to the manufacturer's instructions. PCR products were incubated with DpnI (20 U, New England Biolabs) at 37° C. for 1 hour, purified on a QIAPREP® spin column (Qiagen), and ligated using the ligase QUICKLIGASE™ (New England Biolabs) according to the manufacturer's instructions. DNA vector amplification was carried out using Machi competent cells (ThermoFisher Scientific).

For gRNAs, the following scaffold sequence is presented: GUUUUAGAGC UAGAAAUAGC AAGUUAAAAU AAGGCUAGUC CGUUAUCAAC UUGAAAAAGU GGCACCGAGU CGGUGCUUUU (SEQ ID NO: 170). This scaffold was used for the PAMs shown in the tables herein, e.g., NGG, NGA, NGC, NGT PAMs; the gRNA encompasses the scaffold sequence and the spacer sequence (target sequence) for disease-associated genes (e.g., Tables 3A, 3B and 4) as provided herein or as determined based on the knowledge of the skilled practitioner and as would be understood to the skilled practitioner in the art. (See, e.g., Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1). In vitro deaminase assay on ssDNA.

All Cy3-labelled substrates were obtained from Integrated DNA Technologies (IDT). Deaminases were expressed in vitro using the TNT® T7 Quick Coupled Transcription/Translation Kit (Promega) according to the manufacturer's instructions using 1 μg of plasmid. Following protein expression, 5 μl of lysate was combined with 35 μl of ssDNA (1.8 μM) and USER enzyme (1 unit) in CUTSMART® buffer (New England Biolabs) (50 mM potassium acetate, 29 mM Tris-acetate, 10 mM magnesium acetate, 100 μg ml-1 BSA, pH 7.9) and incubated at 37° C. for 2 h. Cleaved U-containing substrates were resolved from full-length unmodified substrates on a 10% TBE-urea gel (Bio-Rad). Expression and purification of His6-rAPOBEC1-linker-dCas9 fusions.

*E. coli* BL21 STAR (DE3)-competent cells (ThermoFisher Scientific) were transformed with plasmids encoding pET28b-His6-rAPOBEC1-linker-dCas9 linkers. The resulting expression strains were grown overnight in Luria-Bertani (LB) broth containing 100 μg/ml of kanamycin at 37° C. The cells were diluted 1:100 into the same growth medium and grown at 37° C. to OD600=~0.6. The culture was cooled to 4° C. over a period of 2 h, and isopropyl-β-d-1-thiogalactopyranoside (IPTG) was added at 0.5 mM to induce protein expression. After ~16 h, the cells were collected by centrifugation at 4,000 g and were resuspended in lysis buffer (50 mM tris(hydroxymethyl)-aminomethane (Tris)-HCl (pH 7.5), 1 M NaCl, 20% glycerol, 10 mM tris(2-carboxyethyl)phosphine (TCEP, Soltec Ventures)). The cells were lysed by sonication (20 s pulse-on, 20 s pulse-off for 8 min total at 6 W output) and the lysate supernatant was isolated following centrifugation at 25,000 g for 15 minutes. The lysate was incubated with HIS-PUR™ nickel-nitriloacetic acid (nickel-NTA) resin (ThermoFisher Scientific) at 4° C. for 1 hour to capture the His-tagged fusion protein. The resin was transferred to a column and washed with 40 ml of lysis buffer. The His-tagged fusion protein was eluted in lysis buffer supplemented with 285 mM imidazole, and concentrated by ultrafiltration (Amicon-Millipore, 100-kDa molecular weight cut-off) to 1 ml total volume. The protein was diluted to 20 ml in low-salt purification buffer containing 50 mM tris(hydroxymethyl)-aminomethane (Tris)-HCl (pH 7.0), 0.1 M NaCl, 20% glycerol, 10 mM TCEP and loaded onto SP SEPHAROSE® Fast Flow resin (GE Life Sciences). The resin was washed with 40 ml of this low-salt buffer, and the protein eluted with 5 ml of activity buffer containing 50 mM tris(hydroxymethyl)-aminomethane (Tris)-HCl (pH 7.0), 0.5 M NaCl, 20% glycerol, 10 mM TCEP. The eluted proteins were quantified by SDS-PAGE.

In Vitro Transcription of sgRNAs.

Linear DNA fragments containing the T7 promoter followed by the 20-bp sgRNA target sequence were transcribed in vitro with the TRANSCRIPTAID™ T7 High Yield Transcription Kit (ThermoFisher Scientific) according to the manufacturer's instructions. sgRNA products were purified using the MEGACLEAR™ RNA purification Kit (ThermoFisher Scientific) according to the manufacturer's instructions and quantified by UV absorbance.

Preparation of Cy3-Conjugated dsDNA Substrates.

Sequences of 80-nt unlabeled strands were ordered as PAGE-purified oligonucleotides from IDT. The 25-nt Cy3-labelled primer listed in the Supplementary Information is complementary to the 3' end of each 80-nt substrate. This primer was ordered as an HPLC-purified oligonucleotide from IDT. To generate the Cy3-labelled dsDNA substrates, the 80-nt strands (5 μl of a 100 μM solution) were combined with the Cy3-labelled primer (5 μl of a 100 μM solution) in NEBuffer 2 (38.25 μl of a 50 mM NaCl, 10 mM Tris-HCl, 10 mM $MgCl_2$, 1 mM DTT, pH 7.9 solution, New England Biolabs) with dNTPs (0.75 μl of a 100 mM solution) and heated to 95° C. for 5 min, followed by a gradual cooling to 45° C. at a rate of 0.1° C. per s. After this annealing period, Klenow exo-(5 U, New England Biolabs) was added and the reaction was incubated at 37° C. for 1 h. The solution was diluted with buffer PB (250 μl, Qiagen) and isopropanol (50 μl) and purified on a QIAPREP® spin column (Qiagen), eluting with 50 μl of Tris buffer. Deaminase assay on dsDNA. The purified fusion protein (20 μl of 1.9 μM in activity buffer) was combined with 1 equivalent of appropriate sgRNA and incubated at ambient temperature for 5 min. The Cy3-labelled dsDNA substrate was added to final concentration of 125 nM and the resulting solution was incubated at 37° C. for 2 h. The dsDNA was separated from the fusion by the addition of buffer PB (100 μl, Qiagen) and isopropanol (25 μl) and purified on a ECONOSPIN™ micro spin column (Epoch Life Science), eluting with 20 μl of CUTSMART® buffer (New England Biolabs). USER enzyme (1 U, New England Biolabs) was added to the purified, edited dsDNA and incubated at 37° C. for 1 h. The Cy3-labeled strand was fully denatured from its complement by combining 5 μl of the reaction solution with 15 μl of a DMSO-based loading buffer (5 mM Tris, 0.5 mM EDTA, 12.5% glycerol, 0.02% bromophenol blue, 0.02% xylene cyan, 80% DMSO). The full-length C-containing substrate was separated from any cleaved, U-containing edited substrates on a 10% TBE-urea gel (Bio-Rad) and imaged on a GE Amersham Typhoon imager.

Preparation of In Vitro-Edited dsDNA for High-Throughput Sequencing.

The oligonucleotides listed below were obtained from IDT. Complementary sequences were combined (5 μl of a 100 M solution) in Tris buffer and annealed by heating to 95° C. for 5 min, followed by a gradual cooling to 45° C. at a rate of 0.1° C. per s to generate 60-bp dsDNA substrates. Purified fusion protein (20 μl of 1.9 M in activity buffer) was combined with 1 equivalent of appropriate sgRNA and incubated at ambient temperature for 5 min. The 60-mer dsDNA substrate was added to final concentration of 125 nM, and the resulting solution was incubated at 37° C. for 2 h. The dsDNA was separated from the fusion by the addition of buffer PB (100 μl, Qiagen) and isopropanol (25 μl) and purified on a ECONOSPIN™ micro spin column (Epoch Life Science), eluting with 20 μl of Tris buffer. The resulting edited DNA (1 μl was used as a template) was amplified by PCR using the high-throughput sequencing primer pairs provided below: and VeraSeq Ultra (Enzymatics) according to the manufacturer's instructions with 13 cycles of amplification. PCR reaction products were purified using RapidTips (Diffinity Genomics), and the purified DNA was amplified by PCR with primers containing sequencing adapters, purified, and sequenced on a MISEQ® high-throughput DNA sequencer (Illumina) as previously described.

Cell Culture.

HEK293T (ATCC CRL-3216) and U20S (ATCC HTB-96) were maintained in Dulbecco's Modified Eagle's Medium plus GLUTAMAX™ (L-alanyl-L-glutamine) (ThermoFisher) supplemented with 10% (v/v) fetal bovine serum (FBS), at 37° C. with 5% CO2. HCC1954 cells (ATCC CRL-2338) were maintained in RPMI-1640 medium (ThermoFisher Scientific) supplemented as described above. Immortalized cells containing the Mecp2 gene (Taconic Biosciences) were cultured in Dulbecco's Modified Eagle's Medium plus GLUTAMAX™ (L-alanyl-L-glutamine) (ThermoFisher Scientific) supplemented with 10% (v/v) fetal bovine serum (FBS) and 200 μg ml-1 Geneticin (ThermoFisher Scientific).

Transfections.

HEK293T cells were seeded on 48-well collagen-coated BIOCOAT® plates (Corning) and transfected at approximately 85% confluency. Briefly, 750 ng of BE and 250 ng of sgRNA expression plasmids were transfected using 1.5 μl of lipid delivery agent LIPOFECTAMINE™ 2000 (ThermoFisher Scientific) per well according to the manufacturer's protocol. HEK293T cells were transfected using appropriate Amaxa NUCLEOFECTOR® II programs according to manufacturer's instructions (V kits using program Q-001 for HEK293T cells).

High-Throughput DNA Sequencing of Genomic DNA Samples.

Transfected cells were harvested after 3 days and the genomic DNA was isolated using the Agencourt DNAdvance Genomic DNA Isolation Kit (Beckman Coulter) according to the manufacturer's instructions. On-target and off-target genomic regions of interest were amplified by PCR with flanking high-throughput sequencing primer pair. PCR amplification was carried out with PHUSION® high-fidelity DNA polymerase (ThermoFisher) according to the manufacturer's instructions using 5 ng of genomic DNA as a template. Cycle numbers were determined separately for each primer pair as to ensure the reaction was stopped in the linear range of amplification. PCR products were purified using RapidTips (Diffinity Genomics). Purified DNA was amplified by PCR with primers containing sequencing adaptors. The products were gel purified and quantified using the Quant-iT PicoGreen dsDNA Assay Kit (ThermoFisher) and KAPA Library Quantification Kit-Illumina (KAPA Biosystems). Samples were sequenced on an Illumina MISEQ® high-throughput DNA sequencer as previously described (Pattanayak, Nature Biotechnol. 31, 839-843 (2013)).

Data Analysis.

Sequencing reads were automatically demultiplexed using MISEQ® Reporter software (Illumina), and individual FASTQ files were analyzed with a custom MATLAB® script. Each read was pairwise aligned to the appropriate reference sequence using the Smith-Waterman algorithm. Base calls with a Q-score below 31 were replaced with Ns and were thus excluded in calculating nucleotide frequencies. This treatment yields an expected MISEQ® high-throughput DNA sequencer base-calling error rate of approximately 1 in 1,000. Aligned sequences in which the read and reference sequence contained no gaps were stored in an alignment table from which base frequencies could be tabulated for each locus. Indel frequencies were quantified with a custom MATLAB® script using previously described criteria (Zuris, et al., Nature Biotechnol. 33, 73-80 (2015)). Sequencing reads were scanned for exact matches to two 10-bp sequences that flank both sides of a window in which indels might occur. If no exact matches were located, the read was excluded from analysis. If the length of this indel window exactly matched the reference sequence the read was classified as not containing an indel. If the indel window was two or more bases longer or shorter than the reference sequence, then the sequencing read was classified as an insertion or deletion, respectively.

SEQUENCE LISTING (171 sequences)

SEQ ID NO: 1 - protein, 486 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 2 - DNA, 10241 bp, Homo sapiens
ccggcgtcggcggcgcgcgcgctccctcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaattt

SEQ ID NO: 3 - DNA, 8877 bp, Unknown
  Description of Unknown: BE4 sequence
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagcccatgcggcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 4 - protein, 1824 aa, Unknown
  Description of Unknown: BE4 sequence
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSTNLSDIIEKETGKQLVIQESILMLPEEVEEVIGNKPESDILVHTAYDESTDENVMLLTSDAPEYKPWALVIQDSNGENKIKMLSGGSPKKKRK

SEQ ID NO: 5 - DNA, 8811 bp, Unknown
  Description of Unknown: ABE sequence
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 6 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 7 - protein, 16 aa, Artificial Sequence
  Description of Artificial Sequence: Synthetic peptide
SGSETPGTSESATPES

SEQ ID NO: 8 - protein, 4 aa, Artificial Sequence
  Description of Artificial Sequence: Synthetic peptide
SGGS

SEQ ID NO: 9 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 10 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 11 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 12 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 13 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 14 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 15 - protein, 60 aa, Artificial Sequence
  Description of Artificial Sequence: Synthetic polypeptide
  MOD_RES (1)..(1): Any amino acid
  MISC_FEATURE (1)..(60): This sequence may encompass 1-30 "Xaa Pro" repeating units
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
XPXPXPXPXPXPXPXPXPXPXPXPXPXPXPXPXPXPXPXPXPXPXPXPXPXPXPXPXPXP

SEQ ID NO: 16 - protein, 5 aa, Artificial Sequence
  Description of Artificial Sequence: Synthetic peptide
PAPAP

SEQ ID NO: 17 - protein, 6 aa, Artificial Sequence
  Description of Artificial Sequence: Synthetic peptide
PAPAPA

SEQ ID NO: 18 - protein, 7 aa, Artificial Sequence
  Description of Artificial Sequence: Synthetic peptide
PAPAPAP

SEQ ID NO: 19 - protein, 8 aa, Artificial Sequence
  Description of Artificial Sequence: Synthetic peptide
PAPAPAPA

SEQ ID NO: 20 - protein, 9 aa, Artificial Sequence
  Description of Artificial Sequence: Synthetic peptide
PAPAPAPAP

SEQ ID NO: 21 - protein, 15 aa, Artificial Sequence
  Description of Artificial Sequence: Synthetic peptide
PAPAPAPAPAPAPAP

SEQ ID NO: 22 - protein, 21 aa, Artificial Sequence
  Description of Artificial Sequence: Synthetic peptide
PAPAPAPAPAPAPAPAPAPAP

SEQ ID NO: 23 - protein, 24 aa, Artificial Sequence
  Description of Artificial Sequence: Synthetic peptide
SGGSSGSETPGTSESATPESSGGS

SEQ ID NO: 24 - protein, 32 aa, Artificial Sequence
  Description of Artificial Sequence: Synthetic polypeptide
SGGSSGGSSGSETPGTSESATPESSGGSSGGS

SEQ ID NO: 25 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 26 - protein, 24 aa, Artificial Sequence
  Description of Artificial Sequence: Synthetic peptide
SGGSSGGSSGSETPGTSESATPES

SEQ ID NO: 27 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 28 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 29 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 30 - protein, 18 aa, Artificial Sequence
  Description of Artificial Sequence: Synthetic peptide
KRTADGSEFESPKKKRKV

SEQ ID NO: 31 - protein, 16 aa, Artificial Sequence
  Description of Artificial Sequence: Synthetic peptide
KRPAATKKAGQAKKKK

SEQ ID NO: 32 - protein, 17 aa, Artificial Sequence
  Description of Artificial Sequence: Synthetic peptide
KKTELQTTNAENKTKKL

SEQ ID NO: 33 - protein, 19 aa, Artificial Sequence
  Description of Artificial Sequence: Synthetic peptide
KRGINDRNFWRGENGRKTR

SEQ ID NO: 34 - protein, 16 aa, Artificial Sequence
  Description of Artificial Sequence: Synthetic peptide
RKSGKIAAIVVKRPRK

SEQ ID NO: 35 - protein, 7 aa, Artificial Sequence
  Description of Artificial Sequence: Synthetic peptide
PKKKRKV

SEQ ID NO: 36 - protein, 30 aa, Artificial Sequence
  Description of Artificial Sequence: Synthetic polypeptide
MDSLLMNRRKFLYQFKNVRWAKGRRETYLC

SEQ ID NO: 37 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 38 - protein, 1367 aa, Streptococcus pyogenes; identical to SEQ ID NO: 6

SEQ ID NO: 39 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 40 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 42 - protein, 1368 aa, Streptococcus pyogenes [sequence omitted]

SEQ ID NO: 43 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 44 - protein, 1368 aa, Artificial Sequence; identical to SEQ ID NO: 43
  Description of Artificial Sequence: Synthetic polypeptide

SEQ ID NO: 45 - protein, 1368 aa, Artificial Sequence; identical to SEQ ID NO: 43
  Description of Artificial Sequence: Synthetic polypeptide

SEQ ID NO: 46 - protein, 1368 aa, Artificial Sequence; identical to SEQ ID NO: 40
  Description of Artificial Sequence: Synthetic polypeptide

SEQ ID NO: 47 - protein, 1368 aa, Artificial Sequence [sequence omitted]

SEQ ID NO: 48 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 49 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 50 - protein, 987 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDFAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 51 - protein, 1210 aa, Unknown
  Description of Unknown: Uncultured Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 52 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 53 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 54 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 55 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 56 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 57 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 58 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 59 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 60 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 61 - protein, 1140 aa, Bacillus hisashii
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 62 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 63 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 64 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 65 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 66 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 67 - protein, 1368 aa, Streptococcus pyogenes [sequence omitted]

SEQ ID NO: 68 - protein, 1368 aa, Streptococcus pyogenes; identical to SEQ ID NO: 40

SEQ ID NO: 69 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 70 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 71 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 72 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 73 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 74 - protein, 1368 aa, Artificial Sequence; identical to SEQ ID NO: 66
  Description of Artificial Sequence: Synthetic polypeptide

SEQ ID NO: 75 - protein, 29 aa, Artificial Sequence
  Description of Artificial Sequence: Synthetic peptide
PKKKRKVEGADKRTADGSEFESPKKKRKV

SEQ ID NO: 76 - protein, 16 aa, Artificial Sequence
  Description of Artificial Sequence: Synthetic peptide
KRPAATKKAGQAKKKK

SEQ ID NO: 77 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 78 - DNA, 766 bp, Petromyzon marinus
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 79 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 80 - DNA, 10681 bp, Homo sapiens
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 81 - protein, 198 aa, Homo sapiens [sequence omitted]

SEQ ID NO: 82 - protein, 198 aa, Mus sp.
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 83 - protein, 198 aa, Canis sp.
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 84 - protein, 199 aa, Bos sp.
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 85 - protein, 239 aa, Rattus sp.
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 86 - protein, 429 aa, Mus sp.
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 87 - protein, 430 aa, Rattus sp.
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 88 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 89 - protein, 384 aa, Pan sp.
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 90 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 91 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 92 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 93 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 94 - protein, 395 aa, Rattus sp.
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 95 - protein, 226 aa, Bos sp.
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 96 - protein, 490 aa, Pan sp.
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 97 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 98 - protein, 190 aa, Gorilla sp.
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 99 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 100 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 101 - protein, 185 aa, Bos sp.
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 102 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 103 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 104 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 105 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 106 - protein, 229 aa, Mus sp.
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 107 - protein, 229 aa, Rattus sp. [sequence omitted]

SEQ ID NO: 108 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 109 - protein, 224 aa, Mus sp.
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 110 - protein, 224 aa, Rattus sp.
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 111 - protein, 224 aa, Bos sp.
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 112 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 113 - protein, 381 aa, Artificial Sequence
  Description of Artificial Sequence: Synthetic polypeptide
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 114 - protein, 182 aa, Homo sapiens
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 115 - protein, 184 aa, Artificial Sequence
  Description of Artificial Sequence: Synthetic polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 116 - protein, 166 aa, Unknown
  Description of Unknown: TadA reference sequence
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 117 - protein, 166 aa, Artificial Sequence
  Description of Artificial Sequence: Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 118 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 119 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 120 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 121 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 122 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 123 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 124 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 125 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 126 - protein, 8 aa, Artificial Sequence
  Description of Artificial Sequence: Synthetic peptide
SGGSSGGS

SEQ ID NO: 127 - protein, 4 aa, Artificial Sequence
  Description of Artificial Sequence: Synthetic peptide
GGGS

SEQ ID NO: 128 - protein, 5 aa, Artificial Sequence
  Description of Artificial Sequence: Synthetic peptide
GGGGS

SEQ ID NO: 129 - protein, 5 aa, Artificial Sequence
  Description of Artificial Sequence: Synthetic peptide
EAAAK

SEQ ID NO: 130 - protein, 21 aa, Artificial Sequence
  Description of Artificial Sequence: Synthetic peptide
  MISC_FEATURE (1)..(21): This sequence may encompass 1, 3 or 7 "Gly Gly Ser" repeating units
GGSGGSGGSGGSGGSGGSGGS

SEQ ID NO: 131 - protein, 7 aa, Artificial Sequence
  Description of Artificial Sequence: Synthetic peptide
RNEHLEV

SEQ ID NO: 132 - protein, 7 aa, Artificial Sequence
  Description of Artificial Sequence: Synthetic peptide
QSTTLKR

SEQ ID NO: 133 - protein, 7 aa, Artificial Sequence
  Description of Artificial Sequence: Synthetic peptide
RTEHLAR

SEQ ID NO: 134 - protein, 7 aa, Artificial Sequence
  Description of Artificial Sequence: Synthetic peptide
RGEHLRQ

SEQ ID NO: 135 - protein, 7 aa, Artificial Sequence
  Description of Artificial Sequence: Synthetic peptide
QSGTLKR

SEQ ID NO: 136 - protein, 7 aa, Artificial Sequence
  Description of Artificial Sequence: Synthetic peptide
RNDKLVP

SEQ ID NO: 137 - protein, 1544 aa, Artificial Sequence
  Description of Artificial Sequence: Synthetic polypeptide
MPKKKRKVSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDLVLGLAIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTLYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINDKGKEVPCNPFLKYKEEHGYIRKYSKKGNGPEIKSLKYYDSKLGNHIDITPKDSNNKVVLQSVSPWRADVYFNKTTGKYEILGLKYADLQFDKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDFPKKKRKVEGADKRTADGSEFESPKKKRKV

SEQ ID NO: 138 - protein, 1471 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKV

SEQ ID NO: 139 - protein, 1591 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKVSSGNSNANSRGPSFSSGLVPLSLRGSHSRPGERPFQCRICMRNFSRNEHLEVHTRTHTGEKPFQCRICMRNFSQSTTLKRHLRTHTGEKPFQCRICMRNFSRTEHLARHLKTHLRGSSAQ

SEQ ID NO: 140 - protein, 1591 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKVSSGNSNANSRGPSFSSGLVPLSLRGSHSRPGERPFQCRICMRNFSRGEHLRQHTRTHTGEKPFQCRICMRNFSQSGTLKRHLRTHTGEKPFQCRICMRNFSRNDKLVPHLKTHLRGSSAQ

SEQ ID NO: 141 - DNA, 20 bp, Unknown
  Description of Unknown: Target sequence
ccatgtccagccttcaggca

SEQ ID NO: 142 - DNA, 20 bp, Unknown
  Description of Unknown: Target sequence
tccatgtccagccttcaggc

SEQ ID NO: 143 - DNA, 20 bp, Unknown
  Description of Unknown: Target sequence
ttccatgtccagccttcagg

SEQ ID NO: 144 - DNA, 20 bp, Unknown
  Description of Unknown: Target sequence
gcttccatgtccagccttca

SEQ ID NO: 145 - DNA, 21 bp, Unknown
  Description of Unknown: Target sequence
cttccatgtccagccttcagg

SEQ ID NO: 146 - DNA, 23 bp, Unknown
  Description of Unknown: Target sequence
agcttccatgtccagccttcagg

SEQ ID NO: 147 - DNA, 20 bp, Unknown
  Description of Unknown: Target sequence
agcttccatgtccagccttc

SEQ ID NO: 148 - DNA, 20 bp, Unknown
  Description of Unknown: Target sequence
cttaagcttccatgtccagc

SEQ ID NO: 149 - DNA, 20 bp, Unknown
  Description of Unknown: Target sequence
agcaaaaggcttttccctgg

SEQ ID NO: 150 - DNA, 20 bp, Unknown
  Description of Unknown: Target sequence
gagcaaaaggcttttccctg

SEQ ID NO: 151 - DNA, 20 bp, Unknown
  Description of Unknown: Target sequence
agagcaaaaggcttttccct

SEQ ID NO: 152 - DNA, 20 bp, Unknown
  Description of Unknown: Target sequence
tagagcaaaaggcttttccc

SEQ ID NO: 153 - DNA, 21 bp, Unknown
  Description of Unknown: Target sequence
tagagcaaaaggcttttccct

SEQ ID NO: 154 - DNA, 23 bp, Unknown
  Description of Unknown: Target sequence
tttagagcaaaaggcttttccct

SEQ ID NO: 155 - DNA, 20 bp, Unknown
  Description of Unknown: Target sequence
ccatgaagtcaaaatcatta

SEQ ID NO: 156 - DNA, 20 bp, Unknown
  Description of Unknown: Target sequence
accatgaagtcaaaatcatt

SEQ ID NO: 157 - DNA, 20 bp, Unknown
  Description of Unknown: Target sequence
taccatgaagtcaaaatcat

SEQ ID NO: 158 - DNA, 21 bp, Unknown
  Description of Unknown: Target sequence
ttaccatgaagtcaaaatcat

SEQ ID NO: 159 - DNA, 23 bp, Unknown
  Description of Unknown: Target sequence
agttaccatgaagtcaaaatcat

SEQ ID NO: 160 - DNA, 20 bp, Unknown
  Description of Unknown: Target sequence
cttttcacttcctgccgggg

SEQ ID NO: 161 - DNA, 20 bp, Unknown
  Description of Unknown: Target sequence
tcagccccgtttcttgggaa

SEQ ID NO: 162 - DNA, 20 bp, Unknown
  Description of Unknown: Target sequence
gctttcagccccgtttcttg

SEQ ID NO: 163 - DNA, 21 bp, Unknown
  Description of Unknown: Target sequence
cggctttcagccccgtttctt

SEQ ID NO: 164 - DNA, 23 bp, Unknown
  Description of Unknown: Target sequence
cccggctttcagccccgtttctt

SEQ ID NO: 165 - DNA, 20 bp, Unknown
  Description of Unknown: Target sequence
gcacttcttgatggggagta

SEQ ID NO: 166 - DNA, 20 bp, Unknown
  Description of Unknown: Target sequence
tcttgcacttcttgatgggg

SEQ ID NO: 167 - DNA, 21 bp, Unknown
  Description of Unknown: Target sequence
cttgcacttcttgatggggag

SEQ ID NO: 168 - DNA, 23 bp, Unknown
  Description of Unknown: Target sequence
gtcttgcacttcttgatggggag

SEQ ID NO: 169 - RNA, 20 nt, Artificial Sequence
  Description of Artificial Sequence: Synthetic oligonucleotide
cuuuucacuuccugccgggg

SEQ ID NO: 170 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 171 - protein, 23 aa, Artificial Sequence
  Description of Artificial Sequence: Synthetic peptide
RKSGKIAAIVVKRPRKPKKKRKV

What is claimed is:

1. A method of editing a methyl-CpG-binding protein 2 (MECP2) polynucleotide comprising a single nucleotide polymorphism (SNP) associated with Rett Syndrome (RTT), the method comprising contacting the MECP2 polynucleotide with a base editor in complex with one or more guide polynucleotides, wherein the base editor comprises a *Streptococcus pyogenes* Cas9 (SpCas9) domain having protospacer-adjacent motif (PAM) specificity for the nucleic acid sequence 5'-NGT-3', and an adenosine deaminase domain, and wherein said one or more of said guide polynucleotides direct said base editor to effect an A-T to G-C alteration at the SNP associated with RTT, wherein the SpCas9 domain comprises an amino acid sequence with at least 90% identity to SEQ ID NO: 42, and wherein:

the SpCas9 domain further comprises the following amino acid substitutions referenced to SEQ ID NO: 42:

a) L1111R or 1111, b) D1135V or D1135L, c) G1218R or G1218S, d) E1219F or E1219V, e) A1322R, f) R1335V or R1335Q, and g) T1337R, T1337, T1337L, T1337Q, T13371, T1337V, T1337F, T1337S, T1337N, T1337K, T1337H, T1337Q, or T1337M; or the SpCas9 domain further comprises the following amino acid substitutions referenced to SEQ ID NO: 42:

a) D1135L, b) S1136R, c) G1218S or G1218R, d) E1219V or E1219F, e) A1322R, f) R1335Q, and g) T1337, T1337L, T13371, T1337V, T1337F, T1337S, T1337N, T1337K, T1337R, T1337H, T1337Q, or T1337M.

2. The method of claim 1, wherein the contacting is in a cell.

3. The method of claim 2, wherein the cell is in vivo or ex vivo.

4. The method of claim 1, wherein the SNP associated with RTT results in an R106W, R168*, R133C, T158M, R255*, R270*, or R306C alteration referenced to SEQ ID NO: 1 in an MECP2 protein encoded by the MECP2 polynucleotide.

5. The method of claim 1, wherein the A•T to G•C alteration at the SNP associated with RTT changes a cysteine to an arginine, methionine to a threonine, or stop codon to arginine in an MECP2 protein encoded by the MECP2 polynucleotide; or wherein the A•T to G•C alteration at the SNP associated with RTT results in expression of an MECP2 polypeptide comprising an arginine at amino acid position 168, 133, 255, 270, or 306; or a threonine at position 158, wherein MECP2 polypeptide amino acid positions are referenced to SEQ ID NO: 1.

6. The method of claim 1, wherein the SpCas9 domain is nuclease inactive or a nickase.

7. The method of claim 1, wherein the adenosine deaminase domain is a TadA deaminase domain.

8. The method of claim 1, wherein the one or more guide polynucleotides comprises a CRISPR RNA (crRNA) and a trans-encoded small RNA (tracrRNA), wherein the crRNA comprises a nucleic acid sequence complementary to an MECP2 nucleic acid sequence comprising the SNP associated with RTT; or wherein the base editor is in complex with a single guide RNA (sgRNA) comprising a nucleic acid sequence complementary to an MECP2 nucleic acid sequence comprising the SNP associated with RTT.

9. The method of claim 1, wherein the SpCas9 domain further comprises an amino acid substitution referenced to SEQ ID NO: 42 selected from the group consisting of: D1332A, D1332S, D1332T, D1332V, D1332L, D1332K, and D1332R.

10. The method of claim 1, wherein the SpCas9 domain comprises or further comprises an amino acid substitution referenced to SEQ ID NO: 42 selected from the group consisting of L1111R and S1136R.

* * * * *